United States Patent 10,724,096 (METHODS AND COMPOSITIONS FOR INHIBITING AND TREATING NEUROLOGICAL CONDITIONS) - sequence listing, part 139

SEQ ID NO: 2486 - DNA, 736799 bp, Homo sapiens
ggaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaaggtaagggctggctgcacggcccggggcgcggggcgtggggcgctgggcgcgggcggcgcgctcgaggaggccagtgtggggcgcggggccgggcctgtccggggctggggacaatgggagggggagtgcccgggcacctcctcctctgcctctgcctccgcctccagccgccgccgccgccgccgccgccgccaccaccaccgccgctgccccggctgcctcctccctgaggtattgttgcaaatccttccttcccctcaccctccacccgcgggcgcctcgggaacccccagccctcccccggcgcgagcgcctccggggtggcaagagcgcagggcgcgcgccctgctctggcctggcccgctgtgcggaagtgccggccgcggcccaatcacggggtgcacgccatgggggagggggacccagagtttttccaaaagcgtcgaccccaggctaggcggggttggagccttgcgcgccccctgcccggacttttctgggcgcccagggggcggggccacgcccatccgcttagagctttcgcggaatcacagttgtcacagcggaaagggcctagacccagtcctccaagtcctcccattttacagttggggcagctgaggcccagagagaaggagggtcgcccggaagttatttactagaggccagaccataattcaaatagttggctccggacttaagttccctttctctaagcatttctctagcaccctgtgtgtggcagaccctgtgctgggtgtattggacgttgccctcaaggaactcagttgaacctgggagtcaaacctggcctagggtagaaaatgctaagtgctggagcaaaggcgtggacaaagttaaaggaagttccagggagggggtttgattttctggtccctgggacggccttttggagagtcctgcactgaatggggtttttggaggttgaggagtttcctgaagccagctagcggcttggaggaagacatctcttcgagggaaccgtgggccagagaagactaagtagtgtgggaaatggagatgaaagtataaatattctttagttggaggcaaggggttggggatgggggaggttgtgatatgagatgagctaatcagtggaattgtgcctgggtgcttggacagggcagagtctttggaacctcggagtcgtaggagaactgaaaaatctctctggcttcccttcccttagaagggatccactgctttccctcccccaacacaaaacaactagcgagaactcagggtcttctctggggcttttgctagtaccaaactcacttaactgtgtttccagtcccctttctctttccattccttccccttttactaaatctcttgcctttcctgtaaaattcactctcactaaggtgttgatgacttaatggcttacctttccctgcacatgtgcattttaagaaagcctaaagtgaagaaggggaaagtgtggctaggcacctttacaaagcatctagctccctctcccatcctcccccttcctcaactcttatagatagaagaataggtaaaggtccacgaaggtgggtgctagacctagagcctatggtcaataatggtggacagtggggggttaggacatccaatatggttttctccacttcgtcaccagtttttctgcttgcacagttcctgccagcaccagggggcagttaaaggaaaaagtgtgtgggccaggcacggtggctcacgcctgtaatcccagcactttgggaggccaaggcgggcggattgcctgagctcaggagttagaaaccagcctgggcaacatggcaaaaccctgtctctactaaaaatacaaaaaattagctgggtgtggtggcggggaactgtagtcccagctactcgggaggctgaggcaggagaatcgcttgaacccgggaggcagaggttgcagtgagttgagatcacaccactgcactctagcctgggcgacagagggagactgcctctcaaaaaaaacaaaaaacaacaacaacaaacaaaggagagtgtgcatttttgcatttaatttctacaatgcaggccccaaccccaacacccaaaactttatagtctagaatgtaggctccagaggggattacctattctgaatggtaggggtaaaagcctggggccttagggtctggcagtccccccagaggcaggctctctgtaagcagcatgggtctagagttggttttgagtgtacgcagagggaggagaagctgagctgatgagctgattgctgtggctgggacttgagtaggatctttcttagagtgacacattctggtgaagacagttccaggaaatgatggacgggagaggaaacttggttataaaggggcttaaaaatgccaggctaaggagtttggatatatcttaaattcatcatttgagggttttgagcaggctgagacatgatttagaggggaggtactggcatcgagaagccccctgctgcccaattccaatgagagaggtaataatttggcctaagaatattattggcttggcacgatggctcaagcctgtaatgccagcactttgggaggctcgaggcaggtggatcacctgaggtcaggagtttaagacagcctggccaacatcgtgaaaccccgtctctactaaaaatacaaaaattagccgggtgtggtggcatgtgcctgtagtagtaccagctgcttgggaggctgcggcaggagaatcacttgaacctgggaagaggaggttgcagtgagccgagattgcaccattgcactctagcctgggtgacagagtgagactccatttcctctgctgcgccccacccccccaagaaaaataatattatcaattggttcttgttcatttactcgacataggttactgaatacctattacgtaccattggcaaatatgaaaattttatagcagattcctgtattttattgagacaaatacgttgtatcgaatcaattgtaaaacacacttttttcacattttaatatcactgaaatgtggttgtcttattacaatgtaccatagttgtgcagttgtttttcatcctaagttggtaatggcacatcttatagttgatggcttaaatctgataaaattgttcatcatgtcgtttatgaatgtacagtgctttgcactttataaaacactttccaatcagatactccatttgaatctcaaaggtcccctgagaatgaggcctgctgctgctgtcacctttattttaacccttgcccaaggtcatatagctaattagggatgtgttcaaaattacaacccagaacttttgcttcttggtggtgacgtgtgactttaccctgctgttgagccagtctgggttaattgggaatggggcaagagttagatcggatttgatttcagaactatgctgaagatgctggatgatggggattttgtacacgggtagagtgtaactcataagaactgtgtagcccccttagcacagatatttgctgcattaagcagaaaaaagacagggagatagaaaatggcaggtagcaggtaaaacccggggttggagcctgcttacggtgaaccagaaactggcttggccctgagcgtacaaagatgaggtgtacatggtccctgcctttgaggagcacacaagtgtgtggtgtgtgtgagggggagggaaaaaggtggagtggggcatgtccgtgtattaagtgcttttacagggtaagttttggctgctcttcactgagaaggctcaccctcagggaaaccactatagagaggggggtgtctgagctgaacctctaggaatgagtaggagttgtccaggtggaagaaggacaggtgagagaaggacctattagcaagatagtagcagatgcagaagcagggagaagctgctttattctccaggctgtgttttgaaaggccagccatgaagaggaccatggaaaatggagaaagaagagggcctttactttttaataagtaaggtttaaattaatctcgataggggccgttaagtggttctgtagagattcacaggagaataaggctgggtagggtctctagcgtcatctctgtgggagtagttatttggatggtaatgcaggaggcatagtaccacttttagtctgagtgaacctgggactttgaccctgggccgcgattagaggatccaagctgagtatgttcattggtgggtgggacttttcctggaatctggctttggagggctgtgctttgctagaagaaacttagtagagtgaggaaggggaagatataatcatgttgatgcatgcaggaagctagtatctgggtgaaaatctgttggcttgagggaacatatgaggcggagaacctgagggcaaggggaagggtggaaggatttcaagtgtgttgtggaagtctgctgtaggctgcctggaggcttggagaaaaaggctggtgcattctaaatgttggtcacatcagtgagattggtaggtggataggtagctgtaggtagtgtagggattaatgtttggaagcaggtaaaccacagagttgaggctggaaaatgtttcctttcctatcattcttttttaatagtaatataattttgaaatattttcaaatgcttaccacctgttatgtaattatcatattgattcattaaagtaggttttttgattaccagtctcattttgcagatgagaaaatgaatttggtgaaataaggttacacaactaccaggaggcattcaaacttctgcctcattcttatagcctcttcaccactcttttctatgcccacatgcatgaaaagctcaaatcgacattgcttgtctgtgttcttccctggaatttaattcagcccacattcgtggggccctagtggggtcacaattgaggattcacatggacaaacgggcttctcagtcccacactggtgctgttctagcccctttttctctcttaagatgctaccttgggtgtcgtctctccccaaacctaactggaaaggactaagcctctctagcaaatcatctgcctctttcaacagagctcgcttccccagtcccttgttgtgttaagaatgtgatttattcttgtagagaggcagttagggtcataaagtaacagagtggggaagtgacagtcttgaactcagtcattacctttgatctcacggctccggtaacggtgctatatgttctctggtgctgaaccatatagcttctgcgtcctctaggaaagctttctggctcagggctctgagggaacacctacaatccttcctatcacctacctgagtcagatgggtcatctacattttggccactcacagataaaagcattaataatctgtttattgtgttgtgagaggagacagaccccaggatgttcagtagctgtttggtgaatgaacaatgtttatggacacaaataagcatgcatcaccacttcatcttacatatttgtgtgtctgcctcctctccactttaaaataagctgcttgaggattgcagtgatgtctgcttgttgatggctgtattcccaatgcccagaagaatgcctgacacatggtaggcactccagaaatacttgcttgatgaagagagggagtaaaatagttcactgcagccacaggatagcaatcatgggggagcgggactgtttttactgccccagaaccttgagccagttgttgctggcacaggtggcattgggcagtcctgccagcagagtgaagattgagggactgggagtgtagagctgagggttgtgagattaactatgccaaggttaattgcagttgcaactgctctttcacttttccctcacacagacaggtggtctggaacagtcctctgttttcttctcttttgagacagagtatttttttgtttgtttgtttggtttgtttgttttgagacacagtcacactttgtcacacaagctggagtgcagtggcgcaatcttggctcactgcaacctccaccccctgggttcaagtgattctcctgcctcagcctcccaagtagctgggattacaggtgcccgccaccactcccggctaatttttgtatttttaatagagacggagtttcaccatgttggccaggcggtcttgaactcctgacctcgtgatccacctgccttggtctcccaaagtgctgggattacaggcgtgagccaccacgctcagccttgagatggagttttactcttgttgcccaggctgtagtgcaatggcccgatctcggctcactgcaacctccgcctcccaggttccagcgattctcctacctcagcctcccaagtagctgggattacaggtgcctgctggcacgcctggctaatttttgtatttttgtggagatggggtttcaccatgttggccaggctggtcttgaactcctgacctcaggtgatccgctggccttggcctcccaaagtgctgggattacaggagtgaaccactgtgcccagccctctgttttcttaatccatgccttttcttatgctgttttctctacctggagtttccagcctttctgtctctgcctgttgtaaacctgtgattctaggatcaatatcaaaatctaccttgtgccatgaagcaatttccagactccttaacccttccaacccacacgtatctgtgatcagatacaactcaatttcatgtattgagttcggtacttgtgtacaaagtgattactgtatgccaggcagaaatgctagatactggttacaaagaaaactgagataggctctgccttccagagtcttccttctatcataggaaagaaactgaaagagaagatgctaaggctctaataaagtaatgagcaaagggctaatgggaacatggagaaaggagtgaccaatcatctagaagaactggtgaatgcctatggaaaagaagacatttggttgggttttgagaagtgaataggagtttacatggtggataggagtggaagagctttctagccatagggaccttggtgtatgtgcacaggcctgaggcctaaaagtatttgaggaatataaatgtgtgtttggagatcactgtgggagatggggctggctagggagggttagttgataaagagctgatgggccaagctaaggatgatggcagaggtgggagggagcaggaaggcttttattattattatattttgagcaaaggagggccttgttggatctgtatttcaaagagctctggtggcagactgagggcaggttaagaccagaggcagagtcccagcttagaaggctgctgaagtattccaggacaggagaaatgggcctgtatcgggtcagcagcgtacggagggaaaaatggattccagaaactgtttgctgctagaataatatcaggtagcttaattcctacttttgtccttctaattgtttgacagcttatccatcttggctggggaaaagaatttttttaatgtacaccaaagtttgtagtcaacaggagaagcagcaagctgccagccaagcatggactggggccttcttggccagagtgagctgatcccttgttatacagatgaggaaactgaggccccagaaaagggacagagctgctcaatcacacccttgtcagctgaagtggagttgggtcacagcctttactcctaggccagccctgtttccaggtatttttcattctcaatttctgctgtacctcacaccttccttccccactccaccctccactaggggtttctctgctttggagaattttaggagaggatgtaacttggaaattatggtatcttaggcttgaaacttgcgcttcatacttagaaagcaatcagattaagatggttcagtttgagtgtgtgtggtctggcgatttatttatgtaactgccatggatggctgccattgatgcttgtttgtgagaaccaagctatgcttccatgctaatatcaaggttccttgcttttgacagctccctgcccctgctctctaccattctccattaatatttacttatttttgcttgcctagaagtttttaggcaatagttttagatccattacaaggtagatcctcctgtgtttgtcttccctattgaacctgcccatcacaatgtatctcacagaaaccatgagtatttcatagccttcatagcacttttaatgtagcaaatacattttataatcatttgtattactttgttcccaaatataatgcaagagacaagttggctagatcagtcttatcttgcagatattggtcgggagttcaagggtcataaaactttcctaactggggtgcagggccttaagtggcagagtgagaatcaaacccccctctccaaaactcctgtcttgttccttaacttttgcaaatgagcatagttgatgtgaacatccctgcaagccctttacacaggtgagaagtagttattattatttcactagtactaattagtagcattaggtgactatattcaaggctttggaaggcaagactaaaaatcagatttgggacagggagttcaaagatctgggcttcaccataccggatcattttggcaatagtggtgatttttggtgtagggaaaacaaagacctatgtttgggctaaccacaagccctgtgatcttgaacaagttctggaacatccctgagcctaaattacctttcaatggagatcctgtgatctatcacaatgcatttgtgagaatcaggggcatttctgtgatggcgctttgtcagtggtaatgcagtctgtacatgtgtccgattctgggtgcccagcggggcatctggcacacagtgatgacaccttactgtgcttgtggggctgaaaggatttagacctagacaactcctagttcaagtcctcgttgtgctgtttaatacagggtgctcccttggtggtcacaggcactatttgttttctccacgtattcatttttagatctcttattaatgaggtcaccacagttgagtatagtgtgcccgcaaaagtgggatgagtgccacagacattcacgggcatttccaggttgtgcgctgatttgtcaccagtggatggctgtgcagtgtcccttcttccactgccaccatcccaccttctcttgggttttgtttgcactgtttgtatctgttacccgtggagggtctgcttctactgttgtaattgcttgtgttgtgactttgcatcatagctggagatccctctgtagttcaaatggaaagctggtgttgaaggtgaaaccaggtcttcttcagaaacttgtgtgggaacctttcatgggctggataagcatgaggatcaggacagggcagggtcactgaccttaaaggaggatgctttgacctgcctccagcatgcacccttcctgctgaagccattgttagtgtcccttaattactcaggccaccacccagcagcgcaactgtcaacttgcagaggacttcagtggtatcagtagtgttcctttttactctcataggtgtcctgattcggaggatacgttatatggtcaccctacttataggtgaatattgagtgaggtagtgtaaataatgtgcataaggccaggcataaggcaaggactcaacaaacatccactgtttttgttagagggggtgctaggtgctcaagaaatgtctgctgagtggccaggcatggtggctcacgcctgtagtcccagcactttgggagactgagttgggtggatcacgtgaggtcaggagtttgagaccagcctggtcaacatgatttaacctcgtctctactaaatatacaaaaaaaaaaaaaattagccaggtgtggtagtgggcgcctgtaatcccagctactcgggaggctgaggcaggagaatcgcttgaacccaggaggctgaggttgcagtgagccaggatggcaccactgcactccagcctgggcaatagagcaagactctgtctccaaaaaaaaaaaaaaaagtctgctgaataaactacatttatagaagtggaatttaagtttgtttgaagggtatgtcaagatcgtaagcacttactatttatgagggttgataaaatcatgttaatgtatatctataatataagagagtgccgtgggagaggcgcatgtgaaggactgatggacttgtgaattgctggagccttttggaagtgctgagccttcagttagacattgaaggatgggaaggcttagaccaggattcagcaggcagctgaattgctctggctactgagagttaaggaataagattggttctctgttcatgtgtgtactttagctgggtccctgaatctattattttccatccagtggcccatcttgataatgatctctagctgtaaccgtggaagcctaatgctctactaaactctgtgccaagaggtcacagtggaaattcatttccattatgcagagtcatctgcacttgtacttcctagtgaatttccactgaagatggttcttgtttagttcaaggaagaaaataacttggttggcacctggagcttctgtcttgtttggtatgaaaacgaatcattttcaggaagtgcaataaagagttgccacccacagggctgggtgtgccctgactcatgggaaaggcaaactctgccctggccaggcaggtaagtgacaccttttcttagaatgaggtgaaagataggtcagtgttccagtaggtggtcattgtcaccctggaagtctctcttcttggtcatagtttaatagctttacctggagaatatctagggttccagtagtgacagctggacaggaccctaaagataacattctttccataaatttgatacatttgtgtattcatttgacatcgtgtatcaggtgcatctgtgaaagaattagtgatatgttactctgggtttcgacgatggaaacgtgaatgcagtgtggtctctgcttgcaagaggtcacataaatcatcaagacagtatgtagaagtatatgcaaaaaatacctgaaggggctaggtgcagtagctcacattgtaatcccggtactttgggaggccgaggcaggaggatcacttgaggcccggagttcaagaccatcctgggtaatatagcaagatcccatctctaaaaaaataaaaataaaaaaattagccagtgtggtagtgcatgcctatagtcctagctgctcaagaggctgaggcgggaggatcccttgagctccagaatttgaggctgcagtgagctatgatcataccactgcactccagctggggttacagaatagactctgtctgtcaggaaaaaaaaaaaagtctgatggctctaattggatggtaactccctagggacctggggaaactcagataaagagattgtcatttgattgggcattgaagggtaagtgggaatttgtttggtgggatagaggatatttaagtgggagacataacatggatagagacatggaggtgagaaagtgcatggtgccttgaaaaattagagtcatgaaggtggactgcatagtagagaggctgtggagatgggttagggtctacattgagagaaacctttattgctgtactgagaagttgagactgcattctgaaaggagcattgagtagatcaatgagatgactggatctgtgccttaagaaaataatcagctatagtgtgctagacggattgaaggcaagggtgctagagacagcaggagctgtctgagctgctacaatagcccaggcaaatgataaagcaaaaccgaattagggttgaggcagtcgatatgagagatgactcacagatagaatagaagtcacagagtcttctcattttgcataaggggagactcagcacctaagaaaattacacgtgcaaagttcacagccctggtcccagcgtaacactgaggtgatctcgtctgcccagtgtcttagacgggtgacggaacatacggcttttgagagaactgcttgtcaaggaagatctccacccttttttatcttgtaaggattctgtgacatctcttaattctgaatgagatgagatggctctttctggagttactgaatctctaattgctggagatattcaagcagtgactgactgaactgttaccgtgaaagttcaggcattggttgaaaactcctctgcgaggtctttaagacctatcaaccctgatttttttttttcttctttcttcttcttctttctttttgttttttaaatttaattcctgggaaaagagacttataacagtcttatctgggaatgctttatccatttggctcctcaggattattttagacaaaaggcagagagagttaaaaatggatgattgagctctaagaatggtggcctgtagttcattcagagtagtgatggaacaaccatttcgttgccaataaattaatgctcactcatgtgggagatattggtagctggctcagcttgcaggatcctggtcaaaatggaccatccacatagcataatacttatcttgctgttgccatttcttatagggctttatggaaacatgtgttttcctacaaattacaggtaaatcataccagtagtcctgcggatggttattattattgtccaagtttaatcagaagcttgaacctgggaaaggttaaatgatttgcccagaacccaagcaagttaaacattgaaccaggacttaagttttctattatcgcaatgccagattcttcctgttccctgcctgtgcagatctctgagtccggctctagcttttgttcatattcatatccacagcatctgctgcaaatcctgggatgttataaataatttaataaatgtttattgaatgaacatatgaatgaatgaatgaatgaataatatatatgaagtaataaatgatgacttgagttttaagaatagcttaagaaattaaaaaaaccaccaccacctaattgagtaccttcttggcactttgacttttccttatagaggttacagtttttgtgtcttgcattacgtggttatcgctgagggatgtagtagaaactacatggatggtttggagagttagaaggtttggatttaaattatagctctgctaattgttagccatataatcgtgtactggttacttagcctctctgaacttccaattcctcatctctaaaagagtgtaatagtatctttcacataacatgattgtggaaggtattctatggtcagtgtagtaaagcctcaaagcctgccatgttggccgggcacggtggctcaggcctgtaatcctagcactttgggaggccgaggcgggcaggtcacctgaggtcaggagctcgagaccaacctagccaacaaagcaaaatgctgtctctactaaaaatacaaaaattagctgggcatggtggcatgtgcctttagtcccagctacttgggaagctgaggcagtagaattgcttgaacccaggaggcagaggttgcagtgagctgagattgtgccaccactgtactctagcctgggcaacggagcaagactccaccaccacaaaacaaaacaaaacaaaacaaaacaaaacaaaacaaaggcctgccatgcagtgccactgaaaaatgttatctttgtgtgtgtgttgtttttttttttttttaggattctctgtcaacccattagctaataatgcactcactgtatttttccttttatttctccaaattatgacctatggtagacccagtgtttgctgactggctaaatatgttttaagttctttcagagaagaattatagcacaaaagtcccaactatttctatgacttttcagatcagttgccagtcagcctccagaaagactattgacttgcacagtcattagcagtatgtgaatctacttgtttctctgtgcacttaccaggatttaattttataacttgcatttgtctttgctaaattaatatgtaagaaatatcttattattgttttaatttgaatttctttgattactaaaaaaatttcccaagtagtggtttattgtttgtgtttctctttatatggattgtcatatgacaatatttagaaatagtctgggctgaagacgcttgatataaaagggctaaaaatgtttaatgttttgagctgcttaaatttatttatttgtgcattcattcattctctcagtctttattgagctacctactccgtgccaggcacgtgctgcacatactatgaagaaaaaaataaatgaatgaaaacagtgacttccaacctcttcatttaacatgtgtgatagttgaagtctagaaaagtgaggttaattacccagggccgtacagcttgttcagtagcagagccaaccatttatttgaacagtaatgattttaaatgttttgtgtccatagccttttaaaccatggcgacatcctggaaatttcagtattgtgatgttaaagaacatctctaaactgtgtctacgttgaaaaatcagagtcctgatttttggtttagaaaacatggtcacctggttcttcagttgtaaatataattccttcctagacctctctaatgcttaagtctaaattcattcttaaatgaataaacttaatattaaaataagatcaggaagtaaatcccaagccaagcatttcagaccagttgtgaacctcttttgacatgtttttggtaaatgagaagaactgatgacatatttccctatcaaataaaatagacaatttagatttaataaggcagttatcttcaggtaataaaaattcaactaacttgccataactatcttgtttaaagtcaattaagagcctcatatttctcacttgctgggtaaaatttaatagaacttcagttaagcatttattgcttatttaattcaaaattaagttaatcaccacagttggtaacaaccactgagtatttaattaacattcagcaaactatcttattaagtctaaattagatacagacaagtcttgtttatccccatcagtttgcaaacaccacctcccccacctcccatcccaaggggcctttggttttcctacagttttccttttttgattcatcatttttattttcttctacttaagacttcacttgggtgaaagaggagaagaggcagcagtccatcatgttatagaaactttgggctcgtagtataactgagaaactttttcaatcttttcttttttcttcaatcctattctattaacatttcgtttttcaaaaggtattgagcacattctctgtgagaggcttcttttaaaccctaaggaagctataaaagaggtcattctgacatatttggttttattttctcatcctagaaatgagaggattgggtttagtttatccgtgtaacacgtattattggcttgcagtgtgtaaggcacttagctgagtgtttggatacaccttgattcagacaaggcccctgctcttaaagaggacacagaccagtgtgaaagctgcaaagttcagctgtaggaacatgaaggtcctttagaatgctgtgattctgtaagacagtatttcccaaagtgttaaggctgttttattaagaaaagggtcctgtagccaagtaagtttggaaaagtccaagttaaacaaaattaaggaaatttcagtattgtgtatctttaccatgggattttgagactttaataaacgaatgcgcattctgacctcccggaaggtttgtttcccaaagttatttgatcatagaacccctgcaccccactactaccctttgtaccagagcatttcctgggttcagtgatgtaatatgctttggggaaagctgctgtgggccgtggaccctggccacgaacctcccacagcccagaaggggtactcagacattcaccctagtaactatgatacagggtcagaattctactttgtctgaaagttgtgcacatagagtgggtgattttagacatagagtcttttaactggagtggagggtatgtaaccaggacagcctttcctcatggaggagcgctgggtctagcgggagatagactgtgtaggcagagaggcctggagggttgccagagcatcatcgggaacagaataacagtgaaattctgacatggctgatttggtggagactccctaacacattgatataatgtagaccaatttttattatagcctgaatatggagaggtaagaggcaatgaattttttggcgcagaactttctgccttcggctttgttccaactgcgtgactgcccatctgcagaagtgattgttgattcacgtctgtaagacattttcattctcatgctttgtttggggcagagcctctgccttgtgaatcactcttatgagagggagtctcagtttcttttcttttcttttctttttttttttttttttttgagagggagtctcgctctattgcccaggctggagtgcagtggtatgatttcggctgactgcaacctccgcctcccaggctcaagcaattccactgcctcagcctcctgagtagctgggattacaggtgtgtcccaccatgcccagctaatttttttgtatttttagtagagatggggtttcaccacgttggccaggctggtctcaaacttccaaccttgtgatctgcccgcctcgatctcacaaagtgctgagattacaggtgtgagccaccatgcccagccgagggagtctcagcttcttcatcaacagcatcattctagtcagtctagtttccgtttaccttgtcatctaccacttcctccaacttaccttccccccagcttctcttattctggtgaatcacctgtgtcttcatttttcattcttattcatctgaatcatcttcttcatctaaggcaaggtacccttttatatcttcctggaaagacatctacttcatttaaaataatgctaccaatttcctcccctctggtagcaaccagcagatggaacatgctagatgaggtagaggataatctacaaatctggtctgccatatcatgggagatttcacgtaacagtgaattctttcagagcctctcagcaataccttccttgtttttcatatctgtatcaaaaggaacactggcaaacctgggttgtatttctcattccattttgggcttgaatttttctgagtctgagtctcagtttatctgtgtatgaaacgttagggttacgctatgtgtactctcagggccttttaactagaaaatgttgaatttgaatgtttactaagtcaacacaagctgcagtcaccctggattgcttgatcctccatgtacttttgagcctggcagtatgaggaaactcctgcagtgagcatagttcatgcctacacaaagtaggcattccatgaatattggttctcttccatcctgactgcttctggattcattttctttttattgccattgctttttagtcacccaagcttatctctttcttgtctacaccctcaatgctgtaaatcttcctttctcattctccatctggatagcttcctctctcctcacctttttcccttcaggctatgcctatggatgctgtccactctgaaacctcccaaagacaaatgattgcaatggaggcacagattgccgggtggtggtcctggccagctacaaatctttccaagagattagcaccatttctttatggaatcatattgttgttccatgagtgagaccaagtcttatcctcaaggatcccataatggaggtgagatgctttctttttgacacttagtggaaacaacagtccatgaggtatattatcaattggaaaggtggggtttttgctttctaggattgggcaatgcactactaggttctcagcgtggattcttgagtatctaggaaaactggtcatgtggaaagcttaagcttattttgcaggccttgaaaagacagcctgcatgtttcatttcactctctacccgaactgacacttcagggatgaaaatgtcagcagacagccagcaagtagccgactagagggcatgatgtgggctggtggtgcaactcttcaaggatgatatgccagagagggcagaacacagttaggacaaggccaaggatgtcattcccatgtggagaggccattggtaacctcggcgaggtttggttcttctccagtagagattttcagaagctaagaattcaccttgagagtcctttttgcttcctcttcttttgtattaaacaaactactcacctctcagtctttgcctttagtcctttggctattcctggttagataggcccaattccagaagcatctggaaaactctgctctaagtatgtagtgcttaagggccagagctctggagctacactgcctggatttgcattctggcctgccaaaaatacctcaacttgttgctcagtatttttaggcctctgttgcctcatccataaaataataataagaaaattacttatcttgttgtgaggattaaatgagttaatacatataaagcccttagaacagagcctgacatgtgataagtgcccattaaatattagccactgttattatgtgttacccttattaagtcacaaaatggcgatttggaaaagataatagagattatctaaatgattgtgttttttttgttattgttgtctttttaaataaacttttaattttggagtaattttaggttgatagaaaagtaaaaattgtacagggaattttcatatactactcacccacttgtcctcatttttgatgtcttacattactatggaacgtttgtcaaaactaagaaactgatgttggtacattactgtgaactaaactccaaactatttagatttcaccagcttttccactaagttcctctttctgttccaagatctagtccaggatacccagtttaggatcattttaaaactttcatcttctttaatatttatttacttatttttttgagacaaggtcttgctctgtcccctaggctggggtcccccacttgtgtgatcatagctcactgcagctttgaccttctgggttcaagcaatcctcccacctcagcctctggggtagctgggacaacaggtgcatgccaccacacccagataaatttttgtattttttgtagcgacagggtctcactgtgttgcccaggctggtttcaaacccttgggctctagccatcctcctgcctcagccttttaaactgctgggattacaggtgtaagccaccacgcctggcccatattccttaatatttagagaaggattccttatagaaaagcctattacaggtcaggcgcggtggctcatgcctgtaatcccagcactttgggaggctgaggcaggcagatcacctgaggtcaggagttcgaggccagcgtggctaacatggagaaagcccatctctatttaaaaaaatacaaaaattagccgggtgtggtggctcacgcctgtagtaccagctactcaggaggctgaggaaggaaaatcacttgaacctgagaggcagaggttgcagtgagctgagattgtgccattgtactccagcctgggcaacagagtgactccgtctcaaaaaaaacaaaaacaaaaaaaacaaacaaaaaaaaccaacctgggcagcagagtgactccatctcaaaaaaaaagtaagaaagaaaagcctactatgacgtataatgttgtaatcatgtaatctggagcagctgcggatgaagtcgagcaggatgggacccacctttttttcttcccctgatttatctccctgaagggctccagcaaagcagggcttaaaagtcactgcattgagtctccttgttcttaggggaagagactgaggcccccaaaagtgaagtgacaatgctgggagaagctggaagcccagagaagatcagaaaaggatcttcaagataccttgatcctgtccttgttgaataaatgagtgagcaactatcggggactcccaaaaattagggtttggatccaggctcctccacctttcccctcatttttccttatctgtaaagtgggttcactgatcagtaatgtctcataggacttaaccctcacaaaatgccacagttttaccctgtgaaagttaagcaaaccgttgtgcccacttttagcacagcctggaacgtagtaggttctcaatcaatgtttgaaaaagaagccttgaaaatcaggaaattctccccttagaacttatttcaagaagattgggacaagctggtgcaaaacaaagaagagttattcatgaggaaatctgtgacactcaggaatggaaccagtgtttgagtatctgataagcaggatatactgtctgtttttattcttggaggcttttatcatacaatactacattatgttacagtctgactttcacacaaattggatcccaaaacttcttacaggaattaaaaatacaaactcgtgggcagtatgtgttttataaattacagaaaacagtagtgtaaagacatggcatagcaagtgcagcgaagcgtgcgcaggcattgatacccgaggaacgcacgcatgaggcagcagggaaggcacagcatgctgggtgaggcagcaggtgcacagttctgtccctggagcctggagagatgggggaggagggacatctctagctgggaggctgggtgaaggagctgaaccctggagacataaataccctgtatatcttccttatcctgccatttatggtcttattgaagggggccagctgacttctgaaacctcatctccattgctttccctcactcttgtctttgttgcagcactttctgcatttggattaccctgccctgccatcattacctgtttgaatccaattgatcttcaaggtccagcatattaataccacctcttccatgaagcatgccttgatttctgcccatcccccctaagcaggaaatcatcacttcctcttatggttccatggccctttgtctgtactgcttgcatggcactgatcacttcttaccttctcttgtagttatcaatatgctcgtcttattttgggcttttacttctttaggaccttctcgtctgcctggaacttggcaaacagtgaacatttgttggatggatggacaggtttgacactgctgacactagactcaaatttagtttctttagagtagaattttattttattttatattttttgagtcagagtctcgctctgtcgctcagcctggagtgcagtcgtgggttcttggctcactgcaactccacctcctgggttcaggcgattctcctacctcagcctcccaagtagctgggattacaggtgcctcccaccatgcctggctagttttctttgtatttttagtagagatgacattttgccatgttgcccaggctggtgtgaaacccctgacctcaagtgagccgcctgcttggcctcccaaagtgctgggattacaggcgtgagccaccacgccccacctagagtagaattttaacttgcttatctttacatctcccatgctggcactgagaaggtgcacattcattcatttcacaataaagtttcaggcactatttcagcagtaaacagtccatttgttgatagttaacacagagaaaatagtactcattgggatgtgtttttatacttgtaaggtcgatctggatttgtttgtttgttttgatatgtaaggaccaagaaagaaaaggtttgctaatctacgagtatttctggtgtagaatgcaaatgctctcttattccttcaactggctttatactaaaaagagatcactgggctcagaaaggtcctatttttcagataatacagcagttccttactgacttgcctcaggagtaaactccttttccaatttttaaaaggatagtaccaggatgccactgtgctcatagttgggcttttttgtacatgttaatttttttttttttaaatatagtgacagaatgcataccactgaggtggtaaatggaaaaaataagtgcagtggagtatactgtctgtttcttggggccttttctattaatcacaggaggaagcatcagacatgaccagatgagagagccagatgacccaagttcatgccagatcaaaatcagaatggcaaaattgggaggagttgatgctgttgaattgagaaagcataaggttctcagagtgatagagctggaaggatcataaaggtcatctagtctaatggttctcaaactcgaaggaacattagggtcatcctggagagtttactgggccccgtctcagaggttctgatgctgtaaatcaggcgggacccctgaattttcatttctaagaagctcacaggtgctactaatgttgaagagaacctatgatctagttcaacttctgggatttcttgctttctttcttttgtaaaaaaaataaataaataaatttaaaaaagagtttttgaagatggggaaatgaggcctggaaatagaaaagatttgcctagagtcacacacactgtcaggtcaggtagagtcaaaatcaggcaccccgactcacagactgcttcacattgccatcagagattgtcctgcaacaatattatgtttagttctactgcagaatgataactggatcttaccccctttgcctgatctggccacaaacttgtttttcaggtctttccattaggctctcttcagctaattaaaaaaaaaaaaatcagttaacccacatttattgaccagtgctgtgtgttcacaactgtatttagactagtggtatagcagtgcagtagtctgaaaacattttctcatctgtaaacaaagacagtcatacctcctaggactgcaagaagtcactgaacatatacctggcccttagtgtacacattactaaagagaataagatgtggtctgcaccctctcatgcaccagtggcttcttgagcagtatgatagagagagacagctgagatttagtggaaaaacacaaggcttagaattgggagagctgggttcaagccccagctttgccactaaatggctgtgtagtcttgaacaagtcacctgccctctctgagctataatttgaaatagacttagcttaagcaacaggaaagcagtaatgagctagaggaaggatagaaattgggaagaagtataaatctgcttaggagatggcaagtttggggctgaggtggaattgatctgagggagagacctggtagaaagagctaggcagtatgaggctgagtgtctgaaggggtagcaggcctgggggtggtccagtgatggttgaatgggtgggccagcccagcgaggggatcgcctgcaatccagtagagatgccctcattttcatggcagggtccccctgtgccagtagacagacccaggcctgggaaggagggctggttgaagtgagatggataccagtcttggagcatggttggagaatctgtccagggtgatggcatctgttttggattggggccttgaggcacattttcagttctgctccctggaccagcataggagggtggcagacagtacagtgatttgaatacaggattgatcctgccaccttgatttctgcctttatttagcggcaaagacactagatcagaaaagtactggatgtgattgctgtagtctttcatgattgatttaggagctgggagaggcctggctaggagttggaggatccctgggaagatgaagattaggtcttacgtgagcctcagccctctcctctgtaaaatgggagtaatgatggtaattatgctgatgttacctattctgactggagtaaggattaaagtacttgtctggaggaaggcacttcatggttaaaacatgaaaagagaagtgcacagtgtttttattacagggaaacaccaaagagctggaaaggaatgagggctggagagatggagctgccctgaggactctgggaggtcatcctgggggcagaactttgacagttgctgcccgaggtgggacagggatgctgggaagatgtgacgatgtgcataagtgtgtcatgttcaagatggttctaagccctggccaattccatacatgctcttttcctttctcatccatagaggttttggcaaaggcatacttgggagtgttgatatagctgacactgcagcaccctcagtttacaggtgtgagaagagtgaggctcccacagtctcacttggacaggtagtcagggctctgatggagctcctggagtttctaggttctctgtcacttgatagtcagtgctgggagggacctcagggaatcagccaatttcacagatggggagagtgaggcaggttgggaattctggccccagtggagggcaccacatgcccacagggaaatgtctttcccagccccctcctcatgcttctcctcttttctgtctggaagtcctagttctcctcctcacgctgagacccaggtagggtgattgtccatgtttcttcatttatctgttttttttctgttgcccagggactactctaagcaccatgctggttgctgactgttcgcttttgcaagatcttggaatctctgtttgttcacatcacaactcaagaggatacgttctcattctcccaatgtttgtcttctgcccattgcatcaaattgctcttccttgtttggaattaaacttctagcaatcatttacctttatggttctcttaacttcaggtcacactgttgtttagtcaatgtgagaatctttcagatgttctgcactttgcaaaaggatattcacagccaatgtgtgcggcagtgaaggacacttgttgattccttatttattgtctgctgttccagggaccggggactagaggtgaataaagccttgtttgggctgtctaggatgttgtgatcgacacaggaaacagacatgaaagccaaattggcgcagtgggtgaagtattgtaatactggtctctgtttatgatatatggaagaagtttcctagtagcagggtgggtgagagagtccatcatcattgcagattggtgcctctgtggacatgcaggtatattaggccagaggtggggagtgggagagagagggagagagagagcacgacaaagagagagagagagagtgagcaagagagagggagggagagagacagagagagagagagagagagagagagagtgagcaagagagagggagggagagagacagagagagagagagagagagaggttttgagagcattgatatggggtctacatattccccccggcccccattccctattatcatagaagcatgctgccctccaaggcttttgaatttgccaccgtgaagagcatgcatggaatcttcggctgtggccttgcattgccccctgtcttcgcagcggagcttctttatctgacccgtgcatgtgcctctgatgagcagcccttcatcacagctctgcggcctcctcctaggcccccgccttcagctctccagttcatttcccgccttgttcccattgccacctgcgggcttggagggccacctgacattctgtcctttgggtcccctgtgactccagagctccttcccttctggggcgcccacatctgcgacacgcttgtttgcccagtgcattttctacacttagagttcctctcgtgctctcatatttccatttaaagccctctcgagaggtctgtctcctgccagcagcattccttctagtttactagaactccatttctcatcctgccaggaatccagccgtggagtgagcttcagcaagcctctctgcagtctcttgtctgctccaaaactgtggcctctggttgtgagaaatgggcatcctgagtcagtgagagcagtagttagcttgcagcagcttcccctctccccctgagtgagcctttcttcctcttcctcctctttcattcagcctcatcctgccttgggtccatttgacagataatggcaccttgaggccttgtcttttgcatggcatctgtgcctgactggtcagaaattacttgtgaagcaacatagggggttgttggttgggtccacttttaggatgaagtcagaagggatcgtgagtgatgcttggccaataagaatgtattgatttgatttactaattaatttcatttccagacaccaatatatgcatagccttgtttgaagaaaattaaggagaaccattttgtaaatggcaatgagtgtaagacacttaactatcttcctgctctccctggcgtgggcttccgcgctccctgactctgcttttatttaaggtgtctgggaaggcatttgtccttcggcttcccagctggcttcttgccttctcactcactgcctcccgtagcctgtgggcagaatccctcaccgtgcccaccttgccctgctctcgtctgacctcacctctgtttccaggatttgctatggctgtcccctgccagtcatgctctgtgcttgctactctgagtgtgtccctggtcccactctcttgcagcctctgtgtcttagcacatgctgccctgatggcccaagggcccttcccctttgtttctgtctggggaatgttctgtctcctctttcttgaacctccttatattccctcaagaagacttaaggcaaaaacaaacctgaacttactatgtgtggtatttttgtgttataagtgtaggacctagtcatagtaacacatttcaaaaatatggaaccgtataaagaaaatgagcatcactcataaatcactatttagacacaagcattgtttacgtttctaatattctttctttagtggtgcttttcatgattttatgtgcatttgcattttactgactaaatattactatataaacattttcatatcttgccacttcacctaacaatacagcacaagcagcttctcatggcattaagaattgtttgtacatgtaattttgaatggctgtatgctgtttcatcttaagaatataccataattctaatttttcatcattataaatagcactgtgacgaacatccttcttaacaaaattctttgtctgcacctatgattattttctaaggtagattattagaatttgaaatgccttgcacaaaggacagtaactttttcacccttagtttcagagagaacatgttgtctctggagaaacacagaaacatgaaaaagcacaaagaagaaaataggcctggcacggtggctcatgcctgtaatctcagcacttttggaggccgaggtgggcggatcacgaggtcagggattcgagaccagcctggccaatatggtgaaaccccgtctctactaaaaatacaaaaactagctggacttggtagcgcatgcctgtaatcccagctactcaggaggctgagacaggagaattgcttgaatccgggaggcagaggttgcagtgagctgagattgtatcactgcactccagcctgggtgacaaagtgaaattccgtctcaaaaaaaaaaaaaaaaaagaagaagaaaataaaaaccacctgcagtcatttgcaacagccagtgtgaaatttgctacataattgtatctgtgtatctatctttctaccctacaggttgccaaacattttctgtaaaggactgggtagtaaatattttaggccttgcaggccatacatggtctctgtctcctcctcctcttgtttccgctgctgcttcaagattcttttaactatagaaaaattatttctcgctagtaagctgtataaatatcagttttcccacctggttctagcctcaaaagtggagcaattctgtacatactttgaaagcaatgtttaaaaatttatttaatttaattaattaaaaaattaattggttactttttagagacagggtcactctctgttgctcaggctggagcacagtggcatgagcatagctcactgcagccttggaaatcctgggctcaatcaattcttctgcctcagcctcccaagtagttgggactacaggtgcacgccactgcacctggccatgtacatactgttttgtaattgttctcttccacaatttaactacttcatcagcgtcctcatagttttctgttttaggcaacccagatataattactggctttctgctgggatgcccacagcactttggccagatctctgatatagaatttaaggcacattttattgcgagtatttgctgagatgtctctttcttaagtctaactcctcgtgagtctttccagcctcagcacatttcctgagtggtgcttaatagatgctcagcaaatctgtgtggaacgattgccttaggctgcaagtttatcccttcacaatgcctacatttagattgcaactccaggcttgctccttgggccagcagcatcagtatcacttagcacttgttaccagtggagactctcggtctcaccccagaatctatgtctttaggtgttgctgaaagtttgagaagcattactgtagagctcacctctgctatattcatcatgtacttatttatagtcatccctacctcgttcttttcattggtcggaacttcctgtgactagaccatgggtattccttaattgactgacacaatttgtttcacatacagcaccagctgccatctggcctagtgagacctatgtggctgccattgtttttggctgggagtggttgtgatagatagaggagggagcaaatatttaattagcacctgctatgtgccaagtcctgtgcccagctctttacacacattcttccaagggtgagacatgatggtgtttgctgaagggaacatagggatctttaagtccagtgatttttaaccagctaaagaattgaatatatatatataacatatgcacataatatatatacatatatgtacatatattatatatgtgcatatataatatatgtacatatacaatatatgcacatatataatatatgtacatataatatacatacacacacatgcccagcccttactccagtctagaatcaaaatctctgagaagtagacctggtcaagagtacttagagaaaattccctcagtgtttccattgtacattgctggtgaaaaaccaatggtctaggccagcatcctattgtacagatgagaaaggtgaggcccaaagaggtcaatgagcatcccaaggtcacataaatttaatagcaaggccagacctagattttgtactatctgcctgaggacacacttcacattacctgagctgcttctgacctgcagtgttggggtggaagtagaagtgggtgaagaggttgaactcttgtcctcggatctctgagcttgattgggcagctgggagtgtagaaaacaggcaccacgtcctggagtatcctttccattccccctccacctttgcccaccttccttatgtcctctttggggctatgattgaagaggcttgagacattgaagagcatcaatatctactgctctaagtgacccaggcagctgctgtgacatctggtgtcttcctttatctttgtagagtcatgggcagcacctgtaaaggcaggtgtgaaagaagctttgttctgattcttttttcactgtcccctctgtatcagacactgtcatgggagcccccggtcaacttcttgcttccagttgtgcccagccagcagcaaacagaatgagacatcagctgaagcttttcaaagacatcctgtggaagggcatacagacttcatgtagtggccaagggtgtgattagcactgattacgtggcaaagcggaatagaactaatgaccatgatagctgccatttacccagtgctcactgtgccaggcactctgcttgaatcatttcccgtaatcctgtaacagccatgggagggggtgggagtgggagggggtgtgctggggaggttttatggcctcccataagtggcaagctgggatgtgaacccagttctgcttgattttaaagtccatgaccttaattgtcgtactacactgctttcctagctggatatgtgcttataccttctaacctgccactgctaggaatttaagcaaaaagcccatagagatagactgaactagtgtgtaaggacctatggtagcagatgtcaaaaatggagtggactgtatcaattggtataagatttccagttgctggaggtgttcaggcagggaccacggtacctccttgtgggagactatcaaatggaagatttgactggccatcgcagtgcctctgggattctaattcatcggggcttccaagatatgaatttgtttggaagattctgtcatagagcaataaaatgtactttgggtaaaaatctgtggatagggcattggtgaggctctgaaggatttgattttgcacggactacttccagcaccgagagtcctgctgctggggtttcttagtgcctgccatgtgccctgcactgtttggctctggctgggccccagatgtgagaactttcccacaaggagctccccatccaggagggaagggagagcatgctgtcactgaaagataaactatccagtgccagggagtgtggggagagagacaagtgtgctgcctggggagcttacacgaaggatgcattcaatgaaccaggaaatttgttttttaaatattggatttgaactgggctttgaaggctatatggcattcctttaggttgtaggaaggtggtatcgggtcaccatactgagctgtgtggtgggaaaagcaggtcggaccctaatgtgagccttgagtaataaggaattgaagagtgagcctcctgggcttctttttaaagtgaatagggctccggtaaacttttttttttttttttttttaggatagtagagaaagagcaggggtacattttgtaattcaataagcatttgcattgaggccactgtgactggagcaagctgagcccacctctgttaatgactaagagttagcctgaaggagatgtaggttgggcagggcctaccaggaagggggactggctggtgtaggtaaaggggcagtgcagtgtcagcacctaggtttcgaaaggctccagatgctgagatggtgacagggtcttggacgtaagaagagagagctatgaaacacaggcacaggtacagtgtgaaattttggaaatccctaaaaatgaagccaatgggagtgctgctgtgaactgtgatacgtgtttgcacctggccactggcatatcttctatctctgtttgcagagacgccttctttttatacttcttttgatggtagaggaggaaaggacttgagtcttagagccaaggaggcctggttttgaaattgtcctctgttaatttacagctctgtgacctcgagaatgttgtttctcctccctgagttgcagactcttcatctgtgaaatcggggagcgggcggggtggggggaatattcttaccctgtagggcacaggttgcagggaaggagagaatatccactgagtccagtaaatgcaagtcaggaacattaatcttcttcactcgctcttgttttatccagagtagataactctgttttccccctatataccccacagtttatagagtggataactctcttttccccctatataccccacagtttatagagtggataactctcttttccccctatataccccacagttcatagagtggataattctcttttccctctatataccccacagtttattgcgtggataactctcttttcccctacataccctggctgactttgtgcctttgcccgtgtaatttctaccttccagaaagctactttttcttcacatgtttcaatcatttccatttgtttgggtcaagcctctgcatggttccttggacactctccctaggaatcccaacgggcagcggcttcccttctgtcgttctctcatggtgtgggtaattgttgacctaatgttatgttttgtgtttacacccctctcacctgtcagctgcctgagatcaaagttctgattcatgtctcccctctctgcagcactcagcatgaagcctggcacatagcgggtgcccataaatgggtcttaaatgactgagaaaaagaagcgatcaggctgacaactggcatttccctggctttagaaacctgagagaagaaaagctggtgtaggaaaggagtgtcaggcctgcggcttcctatttcctcattcagggcacaggttgggcttgcccggagccatagttcttgagacttaaccacctcaggcctaaatctgccttctttaattacctcctttccagggaacaggagtccttgttgtctgcccagagctgctaaatatagctccaacccccaggccttggtgtgcttctgggccacagtgctgcacagcctgagatgtctgttgattttggggtttcctcagggattctttacattttcaagttttcataagggactgcttcttattttgaagccagcaaagagacttgaagggcacagagtgttgaaaattttataggaggatgctaggagagagttaaagagcttgggtagagaaggggaaagagaagttcttaaaagagggctaggtggcttaaaaagacgaccttgtcatgcatttaatgatcttcaaaagagtgacatcttgtaatggttttcccaggaaagccccttcacatttgacttttgtgacctcttggtcctgctgttggcagttaatcctttctagcttgaaataatttttttctaagtttttttttttttaatttaaaaggtgctataatacaggcttacagtaaaaataaaataatgcggaagtgtttacaataaaacagtaatttcctgtcccatctcttcccaaaccggttccattacccatagtcaaccacttgtaaccattttttgtttttgagtttttttggtggttactatcatatttctaaataatatgcttctgtctcatgcttgagttactagttttagatatgcctattaaactttattttatgataggtaaggactatttatttatatccaattggtccttcccagttctcttcccaagtcttgacagttacatttctacttttattctttgtggtttcctttatgtttacagaatatgcataaatctcagtcttttgctatatgaacttttgacagtttcgcttcactcactattttgtaagatgaagatattagagtttccctccacttttcctctccacatttacccttcaacttgtcaataatgttttaggttaccttttgcatctcgagggtttataatggatacatgcatataggcacatgtatatattaatggttttatacgtatagctaagtcatctgtgctctgtggtttgattgcaaaagctgaaaaaataaataatatttacattatgatttctaggtaaatattgcttaatacagggctaagtcatgtgctgtggtttcatttccttttctggggttctgaggtcaccacctttaagccacttataggagactgaactttcccttagcatcaaaatctaatagatgattgtaattttttctgtagttgttcagagtcattctacattttgtttattttatttctatagtaaatagataataaataagcttcttattataatttcttcttatttcttaaaattttaggctgtattttgtttttgttgagagaaaaaattagcattttctaccatatctcttatgtattctgtcgttctcttgtctgcttggagtctgttctgtgtgtcttcttcaagttccagcaactttttctcttattttggactggtttctccatatctgggctataatttcttacgcagtttccccctcttccctcccacaaagtttctaattgcttccttttatttaaacccctgtgtttttattatggtttcagatatttccaggctttcatggaggcattcttctggagctcctgagtaatgtcattatctgttagtcatcattattaatattcagaagcagatatgttattaaaatattattcaccaattttttaataccaggcagttttgtttgctctttcttttttttctctactgaatattcatagacattctagtttattttttaattcctatatatttaatagccactctcctagtccactgagtggatgtactatttttaaaatttagccatttacatattgttgaatgggagttattgccagttatttgctcttataaataatactcttttgaacatttttatgcataaagccttttcattaaattattttatatgaattcttcataggggaagaaaactggaaagcctgtgtcatcatctttgaggacatatgccagttgactacaatggtgctaggttttagtggggatcacttggcatttcttacttaagatcctcttttttccttttggaaaggagcagtaagaattgggaggggagtaccacctctgaatcagcacatttagttttcttggcagcttttggaagatataatgtattgggacttattgcaaagttggtactgcctagtaattcactgagttatcaccctccttaaaggagtccccaggggtcagccaacactccatgacttaggcccatgatgctcttgtcacctaaaatctttgtataacaattatttggcgaagtgttattcagcatgatcatctccaactggatcatcacccttattcactggaattgtttctcggtgactttgggaaaaaccagattcattcttaaaactcaaagaggaattcccattgagaatatgctacaagatctacaactgcttctacacgtggtatataaggaagggtttgaggaatggcaggttgttagaatgaatggactgctgggaagaaatacatagtgatgggaagcatggtaattgatgtattgaagatgctgcatcattgttggtcaccctgcaccatggtattactataaaacttcatcaggctagcaacatttactctatggttatggatgaaatctgcatcacataattacacaaaaataggatccttgtctttgaaaagcttaacaattcatagatgaacactgatcatactaaaagaatatgtacctgttgccctatggaaaagacctaagcttaatgactcacagtctaattattttggttagtgggtgataatgtattggaggtgatgatgagacacatacatccaaaatctcacagcttggagaggatgtggtccaacagtgctattttatttatttatttatttgagacagggtcccactctgtcacccaggctggaatgcactggcatgactgaggctcactgaagcctcaaccacctcaggctcagtttgtcttcccacctcagcttcctgagtagctgagactacaagcatgtgccatcatgcccagctaagttttgtattttttaatagtgacagggtttcaccatgtttcccaggctggtctcaaactcctgagctcaagtgagcctcctaccttggcctcccaaagcactggcattacaggcatgagccaccgcactaggcccataaggaagagtttctgagatgtgcgagagtgataggcaggccagggccctctctcaggatataattggggccacgctgtggtttctgatatttgaggaatttggaattctgatttatttttgcctaagacacctcattctctggaatacaaattccacatctataaaatgatagggttgtatctgatggcctgggctttgtaaacccttctgttctgagttccataactctgtgattctgggttctgtcccaagtccaagatgatttgaaaagaataaaaaaaaaagaccttgctgaatcagtaccagcgtcacctgcttcagtctggctgggaagtaggtcagaacttggcagacacgagaatgtggttggctccaactgtgagctctgccagggtcctttgtagacacctgccttagaaagggtctgtgaaagaggggggtgctgacactcggaggtggggaagggtttatttttggctgtagatgctgcaagcgaagaggggtgattgatgagaggaggtattgggggacagggaatgaaagactgaaagaaggagaggagcaggcacgtattgggtgcataacttgtgtggagaaatggccaatattttttttactcctcccacacacactgtaacgtaggtggtaggtgtcattctgtggattttttttttttttttttgagatgaagtttcgctctgtcacccaggctggagtgcagtggcatgatcttgactcactgtaacctctgcctcctgggttcaagcaattctccctgcctcagcatcccgagtagctgggattataggcatgggccaccatgcctggctaagttttgtatttttttagtagagacggggtttcaccgtgttggtcaggctggtcttgaactcctgacctcatgtgatccgcccgcctcggcctcccaaagtgctgggattacaggcctgagccaccgtgcctggcccattctttggattttaattatgaggagattgaggcttggagatgtttaggtacctgtccagctaggctgctggtaagtgagggagaaggagtcaatgtggggtctgactccatgtcgcctcttcctttcacgctctaactgtgccatgctctgttctaggcactggggatatagtgatgaaggaggcaggcaaagtccatggtctcataagtgcttgcattctaggaggcaagacagacaacaaagtaaacaggtgcatatttcagagggtgacaagcgctaagcagcagagtatgacagcagtagaaggcaggagtgacagagttgcatgttgtgtttttacatcctagtccataagattgtgcactgagatgagctgatctgaggaaaccaacagctctagagtaagattcttgaggttagaatttagccccggccataatgtgaaccaactgtgaaagttgagcaagtcacctccccatcattgttaaaatgaaggaaaataatccctgttcttcttatttcactagatgatgaaagaagatgaagtgaataagtttgatgtgccaccatttttaaaactctggttggggccaggcgtggtggctcacgcctgtaatcccagcactttggggggccgaggcaggtggatcacgaggtcagagattcgagaccagcctggccaacatggtgaatccccatctctactaaaaatacaaaaattagctgggagtggtattgcatgcctgtaatcccagccacttgagaggctgagatgtgagaatcacttgaacccaggaggccaaggttgcagtgagctgagatcgtgccactgcactctagcctgggcgacagagcaagactttgtctcaaaacagaaacaaaaacaaacaaaaaacccagttggttttaaaaatacaaggagctgtttttaacagtttggttaacttttaaaggataccttcttatatttatttgctacgctttgtgtgcttggaggaaacaactgtttctttggttatttccttattcttagaatgaagacctcctttgccatcttcagaagagtttggatttgatttgtgggcatcagaggaccattaaaggtgtggagccaagagctggcctttaggttttgccactggaagtgggtgaggatggaatggaggggcagcagccagtggtcagagagatggcttgggtaactgtggaaactggaatcaaattcagtctgaccccacagtttgattcaacacagcagtcaggtcagccagtgagcaaacactcactgaaggtccactgtgagccaggtggtggctgaggaggggaggcataggagacattgaatcaactcagccgttgctacgagctcactgtagctgagtgttctggatgctggggagtcatgtgcttccggacctcaaggagcatcttttccagcagttaatatctgttctgttcccaaaagcatataaatcaatgttgattttagtaggcaagttatccatgcagacagagagacgatatttaaatatgtataacactgtattgaaataactctaggtctgccagaggggaactttagttgctggatcttgaggaggtttgagggttcctagggggggattgggaaaattgggatggtgttaggacaactaggagcctcaaaacataaactatttggcaatgagtaagggaatatttaaatattttagcaacctgtgttgctatatctctgtgtactgatgaatgtcagtttctcatgtggttataccactatcttatagcatcctcaatgtagtacttgatgtgcacacaaggcacagaggaggtagcgattagaaaggcttcatggggttggtgatgcttgagttgggttttgtaagatgaataggagtttggtaaagaactttctaggaagaagagagatcatgggcaagaacaccagtgtgtgaaacagcacaggacttgactggacagttgaggggttcaggtctaagggattttgtgctcaggtaattgtgagcacagtcgtcctgttaacagcagggaagaaaggagaaagagcagcacatccatttaatctctcccacagggtaggggaaatatcaagatgagaccatttttatttttattttaaataatagctatcacatgccaggtgttaggcagttagcaaacattgtttctaatctgacagtaactccatgaagtaggaattttcattcttcactcattctacaggttaagaaatcaactcagcatatttaagtgacttgcacaaagtcacacaatggcaagaacagggtttgatctcagtctcatctgactacaaagtctgaacgttccgcttttccactgtatggcctctctctcctgggaatttgcagtgagtgacatccatgagaaacagggcccttttcttgcctagaaatgtaagttgtgacaaaaactggaggtgtccgtatcctgttctgcaaaacgaggacaagagttcttgctccaggcgtcggcagtgctccggaaagacgaggcctcagatgtactgctttccaataccttcagcaagaccattctcagggagatgtttctctccatctttccttgctgcccctgagactttgacttgactttttactcctgtgaaacaacctcctgatggtgatagaaagaataggctgaccacatggacattttgtgtttatgctgttgtgacagggctttcttagagtaaatcaataacatgttcctggttgagatttggcctgtcctataacttgactttagggagagaatgtgctgattatgctgaagatagcgtgttggtttgtgtgtctttcatgtttattactgtacaagaagaagttggcgttctggtacctcccctccctcaaccattacaacaaggaaaacaaaatccactgagaggcagcatagcatggcgatgaagaacatggactgtgagctagattgcctagattcagttcccagctctgtcgctgtctagatctgtgtctgtgtctcggtttccttacctgtaaaacgggaatgatgataattgtagctactgtacaaggttattggaaaggttaaatgagttcatatttctaaagtatgtaaaaaattgcctggcatacaacaagtgccatgtaagtgtttgttaagtgaggacaacaacaaaattttataaacttgccctgctttccactgttccttacaggacatgatatttgcacaagtctgacctctgttgtgtgtggtcaggcactgaagggtgacatgttcacatgtgtggtctggtggacactagttttgatgactgctttgccataagaacttcgctggctatgggaaaatgtgtggttgagaaatagcaagtagaaggttctttttttttttctgctagtaggatagagtttgggttaaatggcatttgcagctgagtttatccatttttaaatttttcctggagttacactgtgcagcctatgcatcaatggttttatctggctcgattagtcagtggatagtttttaatttgacttaaaaaattgggggtcacataaagggaaccagcaaaagatttggattctgatgaacaaggtttaaggctcagctctgccactgacatgctgtgttacatgggcaagtccccactcaccatctttggtcctttatgtactcttctggttctcattgtttcttccctgaaaaaatcagggtgctgaatggtcaggtgagctccctattctctgttggtgagtggccctcattcctggtcagttagccatgggctattgagggaagatgttttatgaagtgtattgatggtaaatttagacagcaaaagaatccaattgatcatcttaattttttcctctgtacttcgtaattgtgccgataagaagtcctcatttcagctttacaccttttctaatttcccagatatttctgtgtatcaccagaaggcagaatggatccaaatagttattaccactcagctcttagaagttgtttgggctggagaaatgttttcattattaggacactttctgggtcctctctctagagaggcaactgagcctcaaccataccatctcccaggctcactccgtcctgcccaatctgtttacatctctactttggaggcaagctctatccagttctactaacctcagtgcgatgactcagggaaaacctagtttctttttcctaggaaaatcaggttgaccacaacttctgtagttcttgagggaagaagggaagtataatgatgttggaagtcaaaatattgacattaagatagccaagtggagttttattatgtatgtatgcatgtagacatgattgaaatgtatattacaagctcatatgacatacctttataatagagaggtacctgtggattctaccttacttttgttagtgttttcactgtttcatgtgagttttacaatgaacctgtgagatttgcagagttaagagttatatacccgtctatggtagaaaacacaggttcattcagaggagtaaagtggcttgcttgagatctgtgtcagtggtagtcttctgactagtgtttcacagagttgttttgacctaagaaagttagagcctgggccagacgcggtggctcacgcctgtaatcccagcactttgggaggccgaggtgggcagatcacctgagatcaggagttcaagaccagcctggccaacatggtgaaacctcgtctctactaaaagtacaaaaattagctgggcgtcgtggcttgtggctataatcccagctactcaggaggcttaggcaggagaattgcttgaacctgggaggtggaggttgcaataagctgagattgcgccattgcactccagcctgggcgacaagagcgagactctgtcaaaaaaaaaaagaaagaaaaaagaaagaggctgacgaaatttgtgatttttgaagcaacagaggaaatttagaaagaatgaaacttacgccgttaatattaagttataccaaggatctactcataatataacccaagactagaaacttaaagtactgtatagttgataaagagaacgaagccgtagagagtttactgaatttctcaatgaagtggcaagcatctatccatccttccattcattttgtcatattattagaaaaaaatacacagcatgccagctgccatgttgagccttgattcatcaaagttaaattagaatgacatatggcagtttagcatttaaaatgtggctagttcgaactgagatgtgccgttaagtataacacaccagatttcaaaggcttagtataaaaagtaatgtaaaatatcttattaataaattatatgatgttcattacttcttggaatgataatattttggatatattgggttaaattaaaatgcatttctcctatgatttcctgctttttaaaaatgtggctgcaggaaattaacaatttcatatgtggcttgcatcttattccttttggacagcactattctagcttgtgtctagtagaggaagtaagatttatacggacatgcttttctgagagcgtggcatctcgcttctttactcctctgcctttatatttgtctctactgcctcaccttcttttggcttcttaacccattctggtcggatggaagttgttcttgtccgggtctagagggctcagatgcattcctttttagcagtgctcttatttggcattggtggtgctgtttctgttgaccactcccagtgtctctggatgttttgttattcctttacctccctagcctctccttggggtttctttgcaggctcttgctctctcttgtatcccataaatacaagcattgcagagctttgtctcatgactgctaggtgtttatctccagtttggaactcctgaacttcaggcccacactcctacatgccttttggacactccagttggaaatcccaaagttgcatggggctcaccgtgtcttttggcattgttagcttggtgagtgacatcgcccaatcctggaaactgggactcattccggatggctcctctctgtccttcactcttgcctctgactgtcctcagtcttacagagtcaaccacggtaacacgtcctgcccacttccctcctccctctacctttggagcctgtcctccattcaggccctcagcatctctctcctggagtgcttcagcagtctcagctggccttctttttctattcttaccctcatccatcctattctctcttttcttcctgagtgatattccaaaaatgcaaatctgttcatgctatgtccctgtttttaaaatccttcaatgctttcctcattcagggcaaattaagaatcctttgcatgaattaagggacaggaatggaaagaggcaggaagtggtttgacccctgcctctttctgtcctcatctcactaatctccaagatgatcttgtgctctaggaatatacctgggattctctgtagctcccgtgacctcacacatagtgttcccttgtctgaaacaccattgcccactctatcagtcctttcaagattttgctctgataccacctctgcctggaatactcctctgactgttattgtctctgcttcctccattttaggccatttgttgaactgggctgcatttccttgagagcaatggtaattctttatatttctgtatcttcaaatcaaaaataggtgtgcaagtgatatttgttgagcaaataaatgccaaataataaattgtatagataagacattgtgggagttgagataaaaattctagccaggtagggatgggagcatggagggttcaaggaatggtgacatttaagattggccttcaatttgggtagtattgggtgggacagtgcagaggagacccctatagtcatggttattgtgccatgttctgcaggactgaaggatattgaataggcccattccctgctcaataccatcaccaccagagtagaataaggatggtaatctcaggagtccctttgggctagtgtctatcattttctcctgagctgggttatataactcggcagagctttattgccccagtacacagctggcatggcaggcaggcactccgatccttgcttgtgagctgccttggaggaagcgagtgcagaatggttgcctgcgttttcatctttacttctccttcacagccgcctttctgtatagcatagaggtgacctcagcaccagagacaggaaagaacacaatgagtcatctcaggccctaatgaggtgcataagggaccctacttaagagtgagggtcaggtgaggtcatgctatgcctggggtgagttttgcctcggggctccaggcggcactggagcagagctgagctaattttacccacaggagctgactgtgctgaagggcagggcttatgacattggccttatcatcctgtgatacccagaaagctcccaaggtgcaaccccgttatgtctgggctgttttcccctcttctagttaaatacatttttccattaggcgtgcatatcgaaaagcaggatgctgaggtgcaaagagctttggatttgggtggaaggccacggagttggatttggatctcgcccctacctttgaccttgcacaagttacataattcgagtctcagtttcctcatttgtaaaacctcattcgtatacctgtgtcctaagattgcttctaggtttacacacttggtgaaacgtagcaagcgattgctatgtgccagtcactgttctagctgctttattcatattgtttcacttaatcctctaaagaaacctatgaggatggtgttattgttatccctgtttataaatagggaaacaaatgcacaaggagcttagataagttgccccaggccaccagccagtgacagagctgaattcaggccagtggctccaggcaccacactcctaaacaatataccttattgttttgaaatgatagaaactttccttgctatatagcacaggcttaatgttttctaactacctgctgtgtataagggcctgggcttgatgctgggtaagagagcagcatagctgttgtgctgttctgtagacttgaatcacatttgtagatggaagcccttggtcagctgaagggtatggtggatagactttggtatctgacattgtaggcactgggtggagtgctcctcacacgacctctcatctcatcctcataacttcttcaatagtcaggcattggcatgcccattttacagatgaggtaatagagaggtagcatcacctcctcacatttacttggtagacagagcgactggggctgttgggtcccatgtttatgttgattcatttgcattccccatgaactgtgcagtgtctcagagctattattgttgcagaactcacccctgcccttctgcccaccactgacaaccctagagaaactggtgtccatgaaaaacgtgggtcaccagatgagaaagtcacatctgcatggtcagagcaggcaccaggtgaaggtaaaagaaagggctgggctttgttccaattgtttattactgtgtagcaaattacccccaaactcagtggtatacaacaatcgtttagtatgctcatggattatgtggatcaggaacttggacagagcaaagggggaatgacgcttctgtgctccacaatgcctgggatctcagctggaagactcgaaggctgggtgctagagggatatggttgctcactcactcacatgacatctgagacgttaaccaggcctgttggtcagaatatctacatgtggtctttccatgtggcctggacttcctcacagcctggtggctgcttccaaagggcaagccttgagaggaagggagagagggagaaagagagcgagtgagcattagcaggtgcaggaagaagctgtagatgcatcatctcgctatactttattggtcggagtagtccccaactcgcttagattcaaggggagaggcaatagactttacatcttggtggggtggccaagttctggaagagcatgtgggacggaaaatttgctggagcctttgttggaaaatacaacggaggctccttttggccaaaaaggaggaacagacgtctctgtggagctgcacggaggtagagccacagggtatgcagcaggcgcacctgtatggtgctgagtattcactggcaaatcaggaaaacaaaggtcaagccaggaatcctaaggaaaggatcagtagttacgctataaccatgcttcattgtatatgaattagcgtttatattgtccataaactagtttgtgtaactctgatttgctgattacatcgactgcttatgtaaccctggagttctaggtctattttggatttttttttttttctgtgagatggggttttcctgttgcctacctaggctggagttcaatggcgtgatcttggctcactgcaacctccccctcccaggttcaagacattctcctgcctcagcctcccgagtagctgggactataggtgcacaccaccatgcccagctaacttttgtatttttagtagagacggggtttcaccatgttggccaggctggtctcgaactcctgacctcaggtgatcctcccaaagtgctgggattacagccttgagccaccgcgcctggccctatttggcttcttatactaaactgagatattttttgttccttcacagaggcaagggagaagcttttagatatagacagacataggtctcagccaaataaataaagaatgagtgatcggttaatttatctatttttttttccctcctgcatctaacaaagttcaggaaagacattctgtataatttaacaggaaagagatgctaacaaagttattgaaaagactggagctactgggtttaagaatttttttttttttttttttctgagacggagtttcactcttgttgcccaggctggagtgcagtggtgcgatcgcggctcaccgcaacctctgcctcccaggttcaagagattctcctgtctcagcctcccgagtaactgtgattacaggcacatgccaccatgccccactaatttttgtatttttagtggagacggggtttcatcatattggtcaggctggttagccacaatccagggataaggaagatgtgattaggaagccactgctgaggcctcagaaacttttctcaacatcttaatagttagtgatggggcactggattggcctatggagtgtccttttgcccttcatgattccctggtattgcttgccagtagaaatagtagcaggaagattcagcttcacttccaccttccagatcacacacaaggaaatcttactggcggaacctaatttactagctttgaggaagtatggggaatgtaatttttaagtcggcttctgtgatgcagaaaggcactctagctggtggaaatagtctgattgagccagccaagagaatatatctacccccaacttatccatttaaaatccccaggagttattattctgaaatacttaatgtttataagtaattataacactgtaatataattacactatgaaattatgtttaatatttgtttatttatgtaaaatatataaacttaatataattaataccctgaaaaaacaggccagttgcccacgttcagtttctgaactgagttcttatttttgacgacagcagttgatttgcaattttccagttcagtttaatctcctcctgggagtcataccctaggacagttgtcttgtttacaaaatttcttcacaaacatttattaaacacttactatggacctgtccctgagctggatttggcaatgtggggagagagaagtcaaggattcttccactgggagccaatactgggaaggagaataaatcaggcacacagttagaacagggcaaggaagatgttgatcaatgccctacacagcaggctcagcaaatccagggaagagagattattctgactgggctgagaagtagagagttttatatagtctgtgatccggtgattctcttttgggggtagtaccatctcattatggggcatttaaaaatgtgacggatgccaggcgtggtggctcatgcctgtaatcccagcactctgggcggctaaggcgggcggatcacttgaggtcaggagttcgagaccagcctggccaacgtggcaaaaccccatctctactaaaaatacaaaaattagccaggagtggtggcgcatgcctgtaatcccagctatttgggaggctgaggcaggagagtggcctgaacccaagaagtggaagttgcagtgaggtgagatcataccactgcactccagcctgggtgacagagtgagattccatctcaataagacaaaatagcagcataatggggtgtcttctgttgtcccaacgactggagatcaggctgccattggcatttagtggttggggccagggaagttagacgtcctttaatacatgaagacaccacagataaaaaactgtctttctccaaagggtcatctcattcctgttgaagactacgagtgtgcttgatgatgtgtaggacgtggatatttggtgttgggagtggaaggatagcaggtcaagcagaggggacaaggtgagccaagagtttagtttaaataaagcaaagaatatgtgttgagtggcaatgggagaaagtttatggtggcaatagaagcttcggtcccggttgtggagaaactagagctactagataaagcacttggacttcccctgttgccattgggaagccatttcagatattggagcaggtccttgagagcagaaacgtagcctcgtcttggcaccatgcatcatgtaaacatcagtaatgctttttgaatgaatgaatgcctcaaactgtagtttacaggtgttagactagtgggtacctgagttttgccagatttaggatcctgtggttctgggagggccctggcagccagcatttggacttttagagaatacatggaaagggcacagtggcgtgccacacagatactgtctccacattgtggtcaggcagcagcagtacttgctgacaccgaagagagatgtgaaaaagagagattcttgcatggactcctgtgtgaggcccataagccatgaggcatgtagggagcagactgtgtcgtctgcatcaatgctcttgcatcttgagcttttaaaaaattgccattcaaaccagcaatttgctgacaaggttcacgcgctatgaccatgactgcagttgatcctggggagtggcttgcttgtctgcctggggatggcagccgcgtgcgttccctgtgctgtcctgtagggttgtggtggctttctgatattcaggttggtcccttttccttctttttggatgggctttcgaggttgggagaggaagctcagggatggaactgactaaacatatgtgagatgtttccttgtttgctgctcatggaggtttcatttctgaagtcttttcttgggagggaaaaggatgtgtggatatatgaggtgactctagaaccctcattttatggatgaagaaactgtgattcacagagggagagtgatttgtccagtgtcacgtggggagctggccggggagccagacctcctgtaccttttattgcagggtttattttatatatatttgctggcaaaaagaaggaaagagaaacaatttatatgttttttatttataataaaaatatttattataattatataataattaaattatagtaaaaatatttatttataatataaatataaaatgtatattatattataattatatataattatattgtaattaaattatatataattttatatattatatattatatatattaaattataatacagcatattgtaatacaatatattttatattaatatagtatagtaaaatatataatatataatataatttcattataataaaatataataaaaatatttaaaaatgtattttatatttacatatatatttaaatatatacatatatttatataaatatatattaatatttatatattaatatatatttttataaatatatatataatataaatataaatatatatttatataaatatatataaatatatatatttttaaatatatatatatttttaaatatatataaatatatatatttaaatatatataaatatatatttaaatatatatatatttttaaatatatataaatatatatttaaatatatatatatttaaatatatataaatatatatttaaatatatatacatatcaaatatgtatatatattttttctcttttttgtagagagaagatctcgctatgttgcccaggctggtctcaaactcctaggctcaagcaatccttctgccttggcctcccaaagtgctgggattacaggcatgagcccctggccttatagcagggtttaaattacacccactttgggggaagagagagtggtgtgtgcaggctttggtgccaaaggcttgcacatggttactggctcagccacttactataaaatttgtaaaataggcaccatggacacatctgatattaagcatttaaaaagaggagctgtgtgaaaagttttgttgactacaaagagctacagacatcttcctttttatcttgatgtggatgtttatgcactgggaattggtggggccatctttagagaaggggtgggccagtgaagacactactgaccataccccaatcagaaaacactcccaaggggctcacttccccactgtgcagtaaagaggttttgcactgagatttggaggtacagcacaaggcggggaaagcatgagccaagttttgagtcctgtggaattgagggtgcactcctgcctggggccaggggttcttgtagcaatataaagggagacgtggctaaaaacatagattgggctcatcctggaggccttgagtctggcctgagggtgagtggatgctatcgtttgtgttgtttagagcactggtgaggagtcaactgggaaaatctcaatgaaatgcatctttaggatgtgccgggaatcttggcagtaactcaggagggcaacagggaatcttgcaattggagtagcggggggtgattctcaagttttggacacattctaagtaactttttgcagtgcttcaactttttacttgagtttataataacaatggcaatattttttatagttgtagagctatatgaaatatttttacacctgttggcttcattgttcatacaatatcttagtgagggggaaggtaggattgttttcgttcctgttttacagacaaggaaattgaggctcagagagcagatgggatttctctggccgcttggctggttgatgtggaagtcaggagtgaggatgccaagtttcacacttcttcctgtgccaatgacctggaggagtgtttttctcaaactcacatttctttatcctccacagtcttgggtgtcactcttggaagtgtaagatggtcatgagtttcaaagatttctgagataagctgttaagattttcaaagatgagctatagagaatttgggacataaaatgtgtttcttccagtaactcttgcttgctatcatgttgttggttcaaattgaacatgttgataagtgccagggaggaaagaaaccagtacctgctacttattgggcaccttttttgccctgaactcagtactgcctgcttttccatttgagtatctagaaacatttatggatggagtgattgtaatattgtacaattctgtcaactagtttattagctaattctcataaaagccttaggaggtagataaacaatattattttccattttacagatgagaaaactgaggtttagagagatgaaataacttgcttataacttgcttgagagaacacaggtcctaaatagattataatctttttttttttttttttttttttggcagagtcttgctctgtcatccaggctggagtgcaatggtgcaatcttggctcactgcaacctccgccccaccaggttcaagcgattctcctgcttcagcctcccaagtagctgggattacaggtgcacaccaccacacccagctaatttttgtatttttagtagagacggggtttcaccgtgttggccaggctggtcttgaactcctgacctcaagtgatctgcctgcctcggcctcccaaagtgctgggattacaggcctgagccactgcacccagctgtaagtagagtataatgtaagttttctaatttgagacttctttcttccttgctgcaccccatctacgccatgtgttgcccatcccactggtgaaaatgcagagctgcttgttaaggaggtacatgtcagaccttggaatttactggaatcagacctggaaggtactatgaagagctcagaaggctggtggttttcaagctgttctcttctgagcctgagagactccaggagtcatcttgagggatatagcacggagggaggtgaaaagtggtgggaagtggaggaaggaaggggaccgctagagccaacctgagtcgctctgctttttcctattttgtaagctaaacattgtcaaagcatccatttaaaggaaaagttctgctgctacatataaaagttaaaaaaccactgtgtctacccttccttttgctaacactgagaggcagagtggttcagcacaaggggacacaaagtggcttagcacgagtcacgagatgtgacgggtctgagacctctcagcctagagctcccttacccctgggccactttgttagacacacctcctttaattcaaatccccgtctcagtgggacatggctttttcattttttcaaggaaaggtttaatctgtccagatccctgtgaagatcttggctcttggcgcacctgctggaggttcgaggtcctgcaaccacagagtagctgcaggaccttcaggatgtcccgagccacaaggtctttgacctgcattttgcaacctggttgtgtctcccctttggactctgggaaccttgctgagattggtacaatatctgtgctaaaaaggtttgaaattatagctagtattgtgttaccttcctggtccaaccttcacagacattgtctgactaagtatatataactcttgagtgttcactgtgtacaccggctcacaagaaaggcaaggttcctgatcccaaggatctaatggagagacagaaacaaatataaacttttgtcaactatttcagagacagttatttttgttatacaagattgttatgcatgctagttatgtggagaggatttcatctcttagaaatgagacggggagaatctgggcgatgagaaagaagaccagaactggggagtacagtctagaattgcaaggggttgagtttgctatgtgaagcagttagttttggactgttgcacttactatttctgagatttgagcatctgacttttcctttaagcttttgttttctcatttgtaatatgggagtgagagtgcctagttcacagggtcattgctggggttaaatgagataatgtatgtaacctgcttagtataatacctagcacagagtaaacactcattaaattttcattgttatcgttgttatgatttggcagcgaggagtcaaaagagcctattttcttaaactcatcaatggtataatcagagctttgcatctcgaagtaaaggaacactctgcttttattatttatttatttttcactctgcttttagacatagaattcaattgcctcaggctacaacaaactggcttcaatctacctttctgagttaacttctgtttatttctatccatctgcccacttctctcactagtgacctacacattttcttttttttttttttcttttcttttttttttttttcttgaggtggactcttgccctgttgtccaggcttgagtgcagtggcataatcttagctgactgcaacctcttcctgccgggttcgagccattctcctgcctcagccccctgaatagctgggattacaggcacacaccaccacgcctgtttagtttttgtatttttagtagagatggggtttcaccaggttggccatgctggtcttgaactcctgacctcaggtgatccgcctgcctcggcctcccaaagtgctgggattacaggtgtgagccaccgtgctccacccacattttctaagcttgattttaacttgctggtctttgtcatatcttctcagtcattgctggggttcaaatctttcttttctttttcttcttttttttttttttttttaaagatgggaatctcactatgtttcccaggctggtcttgaactcctgggctcaagtaatactgccttggcctcctgagtagctgggaccatagacatatgccactgtgtctggcttaaatatttccttctgtcggaatgccctttgttccttcatctgtgcccccctgctccatcctcttttaattcctagcccaaaagtctaacccacccattgggagggattctgcagaactcatagagtttacaacatcttgtccttcaattgcagtcagtctctgtcttgaactggatttgtgagctccttgaagttgtttgtatctcacagctctttgctgtaacatccctggggattcaagcacgcacacatagtagatgctcacacatctatgcaataaattactttagtgtctttctcaaatgatcagcacaggaagcaaatgataaaatgcaaaccagaaaacagacctcactgggctctgtgcttgtcagccttgggaatggatttctggcgaagatccggcccctctacaaatgacagagatgacttggctcttttcaggaattgaagagaatcctgacaagtggcatgttgggaaaggcctgaaggaagccagaccagcttgctctcagagctccttgggtcccctgcggcccccaggtgatcttcagcaagacctggtatgtaaatgagcctcatctgctggctcagcctgctgcccactgctagggatgctagaattccagggtaagcttctgtgagccgggctgggaggtttagtgggttggagattactagctttttggtatctgcagcttgaaataccttgtgcccttgattaattcatgcttgggagcatcctcagtgctctctggaaaatagctccttactgtatgtttatttccccacgggcttatttcagagagactggagcctgtgtttctaacagcttctccaaggaaaacatcgcaggccacgtttccggaactgagaatctcagggggtctttgaaacgtccatctctattacctccttttggcccagcatttgcttttagctgaaaagggagattttgtcttgagccttcctgtagacatatgtgacttggagtttgaaaatctgacagctgctgctgagctttgaactgcaagagtgagcagcatatagacataaccccgtagaacatcaaatcattttcctttaattcccagagacttaatgtttctttgtcttgcgaatgacctcactgctttttgtatttgtaatggaatgcacagtcatttgtaagtaatcacacaataatcccttacacttttataatgccttacccttttccatagggctttcactctcattatctcatatgatccttataactgctctgagatataagcagagcgcctattttaatctccaattttcaggtgtagaaactgaggttcagaataaagttagccagagttaaaacagttagtatgtagcagaattggaaagggagtctacagaattggaactggagtctcctaaaccagtgtttcttttgctccttattgctggtgtgaccttgggaatatacttaacctctctgaacctcagtcttcctatcactaaattgggtataatactacctcctgggatagttgttggaagggattcaatgagactgggaaatcatttaataaaaggtagaacacactaataatgggaggcatcattgtacttactacatgggccttgacggcgaacagtgccatcagaactgtgaaagaaaataacattttttctctctttttagaaagacacaggttcagaatggtgttgtcagggatcacaagctcccagccccgtgattagcaaattgaccctgctgccctgtctgctggctgctttcttattctgagaattgtgttgacaagaccctcttttcctacagagctctctcttaatgttgcttggaatagccttgtgtcctggagacagttttaggtctggcaggatctgagaacaggagtggggatcttggaatgggatctgcatccctgagcttcatccacaaagggtgggaatgtggcttgggctgtggggtggaggtagatgaacagctggacttgcaggtctatcttctgttgtttctcaataaagtagacaagtccatctgatgggtgtttagtagggtatgacttgtgagtccacaaggccagcagtatatatgctgaatggactgcttagcagtaacacactggaaaaatccaaaaagaatggatttcaagttggcaaaaaatgcattagaagtcagcagtgtgatgtggtcaggagaacaaccagagtgactgtgggatgaggtcttggatagctttgtttctatatacagtcagccctctgtatccatggtttctgcatccatggattcaaccaaccaaggctcgaaaatattaaaaaaaaaaaaaatccaaccataaaaaaatacaaataaaaaaaccaatataatataacaactgttcacatagcatttgcattctcaggtattataagtaatctagagatgctttaaagtatacaggagatactacctcattttatataaaagacttgagcatctctggatttcggtatctcaggggtcctggaaccaattccccatggatactgagggaacgagtgtacatactcacctacaaaaattccaaaccagtgagacagacataggttgaaatatggtcctgagaggcagaacgtgaagcaagggatggaaggccggggaggaaccagatttcagttccgtgtaaggaagaactttctgatggaaagatggaatttgcagtggcaggagataatgatctttgcttcactggagacctcaggaataccaatggggcaggcactgggcttaatggcctttatggccacttctaattttgagatcacagagctaggaggatgagaggcacacatatattgaaggaactgaagggtctctctctatgtggatgtggaaactgatctccaaatgtttgcaagatggagggtacgtttaaaatatttcattctggttttcatattgatctctgtggctctccccttggtctttggtttttaaagcttaagaccattcccagaagctcttttccatggaataatctcctttctttgctggaatgctcctgttgggatgcaggaagggactctgagctcctgacagaatgaagaccacccctttttgctctccagacctaattttgacgtcccacgcccacccgctgaggagggttgcaatggcgagatctctgtcctgaattctggttctggcatgcagtggaaggccctctgattctgtttccttacctattttaatagtaacttatatttgtgttccttcattaaatgtacaataaataataaatgtttgcttacggcatgcttgttaagtataaaacaaataatcaaaatgaatgtgtaatgaccctttggatagaccaagtagaagctgcttttaggacacatgattggaccatttctagatatctgcctaatttgtaaatgaaaaatatgtaagctacacaaggagcactgactcgtctaaaatcttaacgactgactgatttgggcttggggtttggggcttgggtccttcatgccctgatcagagctgtttatagcttgaagacttcctgggggtgagaacaagcaacctcttggtgcagtccaaagccaggaaatgggtgacgattttgaaaaaggactcatctgacctccagaaagcctttacaaccaacagtagaacgagatcactaagaaacagaaccaccgggaagccaagatgtggtacttggattcccatctcggagcacctcctatatcccgacacaccatttcccctagtgtctgatctctctttctcctcctttaattcagtctggagtcattttagatcagattcattcctgattggcttcactgctccaacttagtcatcacagaaccttagggttggaatccatgttacaagttaaactgagcaattcacccccacttttcctgacaacagtgttctcttgagagtctggttttattctgagtcttccagcccggtgtctgtgcccatgaaggactcatgccaaattacattctcaggaggactcccagaccaagagactctgggcttgggcgtgagagacttggggctgttctttttctttttttttttttgagaagaagtttcactcttattgcccaggctgacatggagtttcactcttattgcccaggctggagtgcaatggcacagtcatggctcactgcaacctccgcctcccgggttcaagtgatactcctgcctcagcctcccaagtagctgggattacaggcacacaccaccatgcctggctaatttttgtatttttagtagagaccagttttcaccatgttggccaggctggtcttgaactcctgacctcaggtgatcctcccgccttggtctcccaaagtgctgggattacaggtgtgagccactgtgcccggccgagaggagttgttttgagactcacctgccatcataggaaccatagcttaaattcttgtgaccttttcaggtgcatctcccaaaatatctcccctccaccaaattaatgatttatttcataaatttagttgcattctggatggtctcattcttaagatgagcttaaagcctttcagaccagtcacttccttgtttggggtggaggaggttttttcctggaataggacagtgtatggaagggttgagaatccacttctttagcggttaataatttactccgagtaaggaattctttgttaaagtggggcatgttcttcaagtgccagagaagagagaagggtgatttttctgacatcctccagcctgcttctccatatttggaaatgtttacccaccaggctgatctattggaagagagggaggtgactcagggtttaggagaagcaggatttgaattcttgtttccagaaacaaagtcgtccccccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtgtgagtacatcattactgccatttctgctcacagacctggggcttacagcctgtgggctggctcacttgcatggtgatgggacacgttgctgggagtgctggtcacttttatttgggggtgtggacagctgctttcccaggggagtacttcttacagtgggatttcaagacaagatcggcctgaagaaaaattatatttgtatattttttaaaaagtaggtatttcctctcatctgaggcctaacttgagttgggtagaaagacaatttgggagtgctgttgtctgatgattaaggctaaagcaacaagctggaagggatgtcgggatgtctgtggacatgtagggaggggtagttttagcttgaaaacagttatggtgggatttaagagtatgcaaaatgttgatgtgtagcatttgcacagcatccacggtctggaataccttgtgtgcaggtcactgtgtagatttgatgagttgtcagagttggaagagtcctgcagagttttcagcacatctgtctaatttcacagtgtgagataatgggcagcagagacccaggccctgaagacagatggctcattatgtgggattagaacccagatcttctctctcagttcgttctccttcccctagacttaagctgccccctctattgcgagatgaggaaattgggagatgttagaactgtccacacttactaatctagttggtgggaaattgaggactagaacctacttctagttcagacctcttcccgttaggatatatgggctcagatgcctagatttgttgtttttgtatgaggctcttttcttttctttttgttctttgatttttacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaactgggattacaggcatgcaccactaggcctggctaatttttgtatttttagtagagacagggtttcaccacgttggccaggctggtctcaaactcctgacctcaggtgatctgcctgccttggcctcccaaagtgctgggattacaggcatgagctgctgcacctggcctcggatcaacttgagggccttattttccagtgcagggaagatggtagaaatatgttttggggaagcattttattaccagtggcattaggtggcagatgtaatagagcagaggaagtgctctgagacctatgtttgttctggccagttttaaagagaggggaagcgactctctaatctgctttgaagcaagtgggaggagggaagttgcacaggactcccaggaacctgtacacaatctgtctccttctgtgaccagctgaggctgggtggtgactgtaagccctgttcatgagacaggaggagagagccttgaagaaggaaagcctggggtgtttttctgtggtgctgagggacagggacagtaagaggttggagtaaataataccagtatgaatactaatactctgaataaggacagctgacaagcattggttgcttaatgggtgccaagcacagggctaaacactttacctaaattattgtggcactatagctgcctttgagtaggaactattttttaaaatattatttttaattttggtgtaatacatataaaatttgccatcttgatggtttttaagagtacagttcaagcctgggcatggtggctcacgcctgtaatcccagcactttgagaggccgaggtgggcagatcacttgagcccaggaattcaagtccagcttggccaacgtgatgaatccccacctctactaaaaatacaaacattagctgggcctggttgcatgcacctgtggtcccagctactcagaaggtggggatgggaggattgcttgaatccagggagtggaggttgcagtgagccaagattgccccactgcactttaacctggatgacagatcgagaccctgtctcagaaaaagaaaaaaaaaaaagagtacagttcagcagtgttaaatacattcatattgctgtgtaatcagtctccaggcctctttcatcttgcaatctgaaactttgtacctataagcaacagctacccattttcctctcctccagcccctggcatcctccattctactttctttctctatgaatgtgactactctaggttctgtatctaagtggaatcataccgtatttgtctttttgtgactggcttatttcactaagcgtagtgtccttaaggttcatccatgttgtagcatgggtcagaatttctcctttttaagggtgaattatattctgtggtaatgaatataccacattttgtctatccatttaggtactattttttaacctccatgttatagaagaacagcaaccagagacttcaaagggttaattaagtaagtggcccaaagtcacatagtcagtagtggagactaattttacctaagaatggcatgtgatcaggagtaagcagatattggattctaattggcaagagtgtgacaaatcagggtgcttctcaactggatggtgacacctccttacaccttgctatggcatttcaataaagcaagtgttccaaagggctgtacgcagctatgcttcctttcttttgtattgggctctaggaagcccatagctaaatttaaagctcacctctagcaaatggtatgagacatccagctcttattttttgtatccctttctcctttctttgctttattttctcctctccttacccactttctcacttaaatcatgaactattagcatcttttgtcaggtacctcagatcatttctggaacaaggcagaatatatagatatgtggcatgatatctaatattttagtaattattaagtctgtggaatagtaggccaaaactggccatgatttttctgacttgactctgctcgtcttcttcttcttccttttttttttttttttttgatggagtctcactctcttgcctagactggagtgcagggcgtgatcttggctcactgcaacctctgcttcatgggttcaagccattctcctgcctcagcctcccgagtagctaggactacaggcacttgccactacaccccactaatttttgtatttttagtagagacggggtttcaccatgttgaccaggctggttttcaactcctgacctcaggtgatctgcctgcttcagcctcccaaagtgatgggattacaggcatgagccaccacaccccacctaactctgctcataatgcaatgtttcatctgggcaatgccctgcccctttctgagtctcacttttctcacctgaaagaggaggttactgttgatgacagtgaacatttaggctgtgctgagttttacactaagcatcctgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcaggcttcttccatccgtggcatgtattcatctaattttattaaatctttattgagtttccacttaggtgccttgcactgttctgggcattatcccagtactcgatttagagcaaagagtaagacacacacaacaacgatctcttggtgcttacacgctgctgcaggtgtgtgaaggaggcagataaaggaacacttaaacaagagggactgataagtaacccaagggaggagtcacaaagggcattctgactgtgagtgagtggggaaggactctgggaggttatgtttaagctgagatctgagtgacaaggaggccaccttgtagaagttgggggaagagcactgcaggcagtggagacggtcaatgcaaaggtcaaggctgtgaagtgggaaggagtttgtgtttgaggaacagaaggagactgatgtgctggcaggatgtgggctgcaggggaagaagcaggagaaaagaatagggtctagcaggtggtggtaagtgagagacctgagcttcttagacctgagtccagatgtgatgggttatgtgttacaggcatctttccagctgctgtggagggaacctgatagtaaaagggagtcaagggtagaagcaagaaggttaggctagacttttaccgtaattcaggtgtgatgtggtggtaactttgactagggcatagaagttgggcaggagaggtaagtttggggcatgtttgggagtgatcgtctataggatctcaagtgtgatttccttcagagaaatgctgagctaaatgggcaggaatctgggatactcagagggaaatgaaaataggtgccctagggggttgcccagataagcagctggcgttccaagaccaaagagtatctgtttctcacccctctcccatttagtttctaaccttgagctttgggccagtgcacagaggatggtggcttcctgcctttggcttcccagctgagagctgttggaacgccccaaaataagccctgcagaacgtgcagcttcctttgctctccctgggtatttttgtaaaacattctttcccaccaagaatgaggaacgttcagagtgatgctgactttatgggctgtatttaacatgttgttttttcatggtgttgtctgttcatgcagagatttctgtctcctgtaaactccctggtaaggaatcttcaatctccatgtgagatgggtctggaaggctcagtgggagcccagaagagctggggtttgaaagcctctccttgtcttgaggactggactgcggtccaagggcacctaccagccctcttttttcatttacatttgaattcacagttgctgccctttggcagttccctgtaattccttttaacaggctgggctttcctgcagatacttcatttttcaggtcttggagaagttaggtagtggctgaatcaggtagagaatccaaaattctgaccaagccccatcctctagccaccaggccaaagcaacttagcttgtgacctcatcctcctgtgtatcccctggcaatcttatactataatcagcctaagcccagagatgctcagaaatcatacactaagtcatctaaaactcatttctgaggctttctcatgcgcccctcttgcagtctgtagttaccaggttttcaaataattagcataatctcttaaaaacagtgttttgttattgctcattcaagtttcttctaaaatttcttttatattacctattcattgagttgacaaacatttattgagttcttactgtatgccaggcattgtgctaggtgctggggattgattcaaagataatttggaggcgtatggaaggggagtggataattacagcacagtgagataagtgctataatagggggatatataaagagccagaaatagcactatgaataacatctttgaacaaattgccttcttttttccttttggattattcccttatgtatattgcccaaagtgggattactgggtcatttaaaagatgaaaacaatttggcacaaaaagatgtaatgacttgcctggggaatacagctcaattttcaacagagaaagaaaaaattgttgacaaatccagatttagatcactttaccaggaagatggggcagtttttatactaccctttcaacatggtggcttttaggggcggggtgggggggatttattctaaacatgttagcctgcgtgtaggaatcacacgtcctcatatttaatctcacaacttgattgttctcacaagaacctagctgtatacatattatcgtttccattttacaaatgaagaaactgcacccttgataaaaggaagtaagttgctcaaaattccatagttaataagtgtagaatccaagggtcaagcacagttccttttattctttgactctatcctgttccccatgctgtgtttaccaattgagggtacctgtgctctagccggggcccggaatttaatatttaatgagtcacggaggctcttaagatgatggtcaggctctatgaaataggtgtagattttcttacctctgaagtcatagccagggaacaatgtctttctgtatattgacctgaaaggacccaagggcgcattattcctgaccctggctcaggtgctgaaaggctatttgcatagccctactgttagagcacagaatcccaagtaaagctgaaaccatgccacagttttgctgtgaaacatttattacttttctagtacttaacagtattaagtaaaaactcctgcccctggtatccaggacctgtcataaatggacaccaacatcggtccactgtgggtccatgtgggtccttgatgctcctgcttacatatctttaaatcaaacacatttcctaccaacccccagatatatcttgcactttctcaccttcatgccttagcacatgcctttcctttagcctgagataacctctccaatcttcattcatagaactcccaatcctcctgtaaacttctgcacagacgccatcttgggaagggaataatccttgatcaccacctgctctcccatccattagaagtgatctctgtgttctctgttctgctaactcaaccacagttagctgtgaggcaatagagtacaaatgtatgctgcatatgagcatgggatatggatttgaatcccggctgtgatacttcctcactgtcagttaacttgcttgagcctgagttttcccatctgccagatgggtgtgatacaataggtgctccccctgaaacccaccatgttgacaggagtagtataaaaatggtctgattctcccggtgaggtcacgtaaatctggaatcgtcaacaattttcctttcctttgttgtcatgacttttttttatgacatcacctcatgtcatgtcaccgtgtggtatgaaaatttgcattgttacctgtgcttcttctgtggcacttgtcctcccttacttgatgtcttatctctccttctagactgggagctcttcaagggcagggagggcattgcatctttgaaggccttgacatatggatactgctacaaagtttcctttaagggaaaggaggattccatacaacctaagtggtgacatcagcacaggctcattactaatctcatgtcacgaggtttcaggcctggctgagaactctgtgagctctgtgatgttgagcttcaggcacatagagtacaagctgggtaggcctctggctcctgcttaagagacagcagaaaggctggatggagcctgtctccagaccagcttcttctgattcaaggagttgggtgggactggcagttcactgaaggcagagtggtagtcctgcttggaacgtgaaactttgtttctttcctgggccttccagtgggtctgttatgttggtgagagtttcagacctagaggaaagggtcactgaaggtatgggttaagagcaactctgaaagccacctgccccccgacttctctgtgagtggggccacagggagaagatcccttcataggtagctcccctacccttgctatgcttggaaactgaccatggaaagggattcatttcttaaagggatagggctaccatttaactttctattgtgtcacttcccgaaacgcaacacctatggcttaagatccaagtgctttagaacatgagatacaaggtcttccaggctctggctgccacatccctttccaggcgtgtgtcccaccacattcctctgcatcctctgtcactggcctcaccagattagtcactttctctgagaacaccctgaactcatccttctcaaggcctttgcacattgtgttccctgagcctatttttctcctcctcatccgtggaaatcctcttgggtgttcaggcatcgtttagaagtcacatcatctgcagagaacttttagaccctcaaaaggacgttgcatgtactcgtgcttttctacacttttcattctgtcttttgtgttccagtgtgtcccccattgaggctcttcgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttgtttttatcccaaagctccatgaaatatgaaaatagcaggagttttaaaggtatatttccacctctagaggaagaactgtccatattatagttgtaattataaattaataaagcctgtgtcatgaaacttgattttgaacgcctgtgttcaaatcctggctttaccacttactagcctagagatattggatgagtgtctaacttctccgttcctcagtttcttcagtgttcaattgggaaatttttcttatggttgatggaaagtttaaataaggtcttggatatgaaactgggattttattagtgtgtgtgtttcaaaatgtggatttggaggccatttaaaaatagcatttccaaaaagtttgcttttaaagcaaagtacttagatatataaatttttatgaattttttttcaaatgataaaataaatgagtttacagtcaggagacatacagtatctaacaaacttagggaatatgcttggcttacaagacgtggttttagtccacataaattagaatcacagaactataggctttgagaaattataaaagccttggaaggggtgaacgtgaattagtgcatattgtgtgcaggctttgtgccatacgtgctagatatgggatcccaggaaatggttgcatacaccttgttgggtagatgatattaaccctgttttgcagacagagaaacctgagctttgagaaaatcctttacacaagtccaatatcaaagtctggaacttcaaactgcactcctgatggcttctagaaatcctttccatttacagatatgacaagacttgctttcacattgttgattttttttttatcctctctttctctgtctctgggggcagcactaattcagggccagatagaactgtgaaaatctgcagtgttgatgtcacataacttgtttaatgaatctagattagtgtcttgacttttcctgccaagaatctgctcataaagtgtcttgttttgagctcctttaactgtactcattcatcagcctttacttattttcttctcttttggagagatacttgccattgcccataatgtttgaggtcaggagtatatttgaagagggctttatattttcttaaaaaaaatacaggtggaaaatcaagtttatcagctatttcataccatcttcttctgccatttatgggcaacatgtggaagaggtggcagggagctgggagtttggaataatgtgtctcatcttgaatttgtcgctgaccagggaaaatactcaaggccaactccatcattcccttttgggaattcggtgcttcagctgtaaagagtgagggcactactaggtgattcctaagatttaaaattctgcatgttttgtggtgtcaaaaccatcaatttctggtgagctgcgtgatcctgcagctgtttctctgatacttttcaatctttagatttaatctattcaacaatgtataattttttaaagggaagcttttatagatacttctgaactataaccgggtgggggggataaatggatgttaaaaaatagaaaacaaccaattaaatagtatatagcatgtaattctccttggaaacttaccacgaaattgagaagcactttaacaactggtaatttaaattgcgtttgaactctgctaatggtttgtttgcatgggaacttcaatcatttcacagtggttctttagcaaagctgcttgttctctttatggaaaataagaaaaaattattaaaagagaagttggctatggaaaatggagaccactttcatttgtgcctggagggaagctggagagtgtgagtgagactccctcagggccaagggtggagagctcttcctttcagtgaagtttaaaaatctgggaagtcagatgccctttgctgctgttgtagaaactgttgtgatttgtatctctctctgcaaggagaagctttggttttatgcagcttgcgggtgagggtagggacaacctttttcgtttgttttatgaaattgcattgttcacaggtctaatgttggcttcctaacaacccatttctcagtaagtttgaaattatgcctctctctcctttcagtggaaatggctttcagaattccaatgtccttgaagaccactaggtctcaggaaactccttgcttttctgggctgatagtgattatactccattttgcctacttaatttctgtctgctgttgaggttactgggagagcgttgaaataggtgttcgaggcctggatttgtaagtcctggtttggctctaggtgtgactcatgtgaccaagcacaagtccctctgcccagtgtgttttgttgtcctttgtcaaagcaagcagtcacttgatccagtggatcaagtggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctcgtatgtggatttctcctgcatacatgaaagacaagttttataacagcccttgccttgggatacttgtctgttggcatacatactgtgtaatcattagcaaaacaataatagttgctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatggctgaaggcaaaggaggagcaggtgtctcagatggcaaaagcaggagcaagagagggagtaggcagaggagttgccacacacttttaaatgaccagatatcatgagaacacactcgtgatcgtgaggacagcaccaagaggatggtgctaaaccattcatgagaaatccgcccccatcatccaatcacctctgcaggccccacctccaacagcaggtattacaactcaacatgaaattcagaggggacacatatccaaatgatatcaaggacggcttactgggaaatgtcaagattgtttatccctctgctgctcactgattctcacttttcaggcaaggaaactaaagttcaaagaacattaggtcctatagttagaaatttgtctccaaactcatattccttttctttttttatttggtatagtttaggtttatctgttaatttttttcttccctacaatttgagtatctaactgacttgcctctttcacctccattattaagatgaagctgttttcccaggagaactaggagagctgagatatgaacactgaggcatcagcattctctttccccatcattctgagtcaaattagtgaaataagagtgccaggatctgactaggagtttaggaggtatagaagtaaaccacggcccagtcagagactttataagcctgggaatttctgaagctggttaagaccctagagatacataagcaacacccttctgtttttcataggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtactcacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatgcctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcttggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatatgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgaggttgagtgaggtcacttttcacctctttgtcttctttgcttcctaggagttatgatgtccccactattcaaatttatgtcaaagatggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattattggttcccagtgcatatgaaatttatgtttacactatactgtagtctcttaagtgtgaaatagcattatgtctaaaaatacagtatacataccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtactggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtgacacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgctttttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggtaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatacttgtgtatgcaaagactttaacatttattaataattttttctatagattggtgaaattggtttgtaatttttgtcatttcacttttgtggaaattgagcaaaagtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctttctctttctttctttctctttctttctttctttttctttctttcttttctttttctctttctctctttcttttctttttctttcactctctctctctttctttcttctgtttcccctcccttccttcctcccttcccttcccttcccttcccttcccttcccttcccttcccttcccttcccttccctcccctcccctgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctttctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacatgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttatagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctgctgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgaagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttcgctcagactcaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctgtctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggatttttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgtcctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaagaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtagatgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatctttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaactttttttttctttgaaacggagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcaccccccaccctccaactctgtctctctctctctctctctctctctttctctctctctctctctctctctctctctgtctgtcctcctctcctgctgttgccatgtgaagtgcctgctcccttttgacttctgccacgttgggaagcttcctgagcctccacagaaggagatgctgctatgtttcctctatagcctgtagaactgtgagccaataattcaacaactcaaccacttcttttcttttctttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacccatttcttaatctctctaagagacatggactgtgttaaagtgtgtttatgaactggtggtcgagggtgcatttccctcctaagaaaactcattccttgttatgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttattctccattcccatgatttagccctctaacttcatgcatttctttttgccctttttcttgtgctggattttagcccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacacgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacccgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaatttgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagtgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaatttttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacagaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttatatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcggatcctctatttcctaattcatggcaacttctggagaacagtattttctctgttactgctttatggggtttagtgtggaaattaaagaagagaacttcttattttttgtaaataataatacaatattcagatactgttagtttctgaaatttaaaatgggcatctcacttctgtgttccctccccaaataaatgtattgatactaaaaaggaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttatttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagtggaggtgtaaaaactagtcttccagcctccagtcctgtctcagcattgctccccttcacgtcgttgtccagagctcctggtggagccttggccttttccatatgtacacgtgcacacacacacacatacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctctctctccaccccccaccccccacccccacccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggaggttattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttctctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagcgtcctgaccatctgtttctttctaccccaggcccattcccatcatgagtatttattctgcccagtgtgggatgggttctgttctagaagtttgcatgagcagagggaagcttagccccatgaggccagtcatgaggctccatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccgttaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccatttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagactttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcaacctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattctcagggagtttagagacaacataatgaaggtattttcaaggtttggggagctgcttggaacttgattttggacaaaatggaaggaaaacaaccatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttgtggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcacagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggtgtgcaccaccatgtccagctaatttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacccatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttctctcctcctcctcctccttctcccttctcccttctcctttctccttctcctcctccctcctctccttctccttcttctttttcttcttcttctttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccggagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacagaaagataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaattttttttttttagttattcttattttctaattattttatatgctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttcttttttttttctgttttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtcctttgtagggacatggatgaacctggaaaccatcattctcagcaaactatcgcaaggacagaaaaccaaagaccgcatgttcttactcacaggtgggaattgaacaatgagaatgcttggacacaggaaagggaacatcacacactggggcctgtcatggggttgggggacgggggagggatagcattaggagatatacctaatgtaaatgacgagttaatgggtgcagcaaaccaacatggcacatgtatacatatgtaacaaatctgcacgttgtgcacatgtaccccagaacttaaaatattaaaaaaaagaaaaaaaaaagaatttgcatctatttttagactttctgttctattcatctgtcacttcatgtgtcattattatgctttcaattattgtagctttataatatgttttattatctgacaaagattccccattcctattagtttctctttttcagaaaatttctggcttttaatgcctgtttatttttcattgacctttataatgaacctatctagttctggctgggcgtggtggctcacgcctgtaatcccagcacttcgggtggctgaggtgggcagatcacttgaggtcagaagttcaagaccagcctggccaacatggtgaaaccctatctactaagaatacaaaaattagccaagtgtggtggcgggcacctgtagtcccagctactcgggaggctgaggcaggagaatcgcttgaactgggaggtggaggttgcagtgagccaagatcccgccactgcactccagcctgggtgacagagtgagactccgtctcaaaaaaaaaaaaaaataaaataaaataatgtaaaaaagttctgttgatatacttatgaggtttgctgggtttatttgttagcattacatgctatacattgtaaaaatgttgattctttttcttggaatactaatgcctttccatttgttgaaaccttctttgatgttcccaggagcactgagatttttcttcatgtagaccgtgcctgtttctaataagttaattttgtagatattttctacttgctctagttaatgtaattattttctatttcatttaattatatgtgtgtgtgcctctgtgtttggggtctggatttcagtacattgattttctgctcagccactttactgaattgtctcattatttgaataattttagataaattttttttgagtttctagttaagtaagtatattatctgccaataatttatcctttctttccaatttttacaacacttatagctttcttctaactgtactaatacctctagaatagtaaatattaaataactgtggttgagtaaatgtccttcttttgtgtctgagtttaatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaacatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcttttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaaccatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggaggttgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctggggggaagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgtcaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaaaaaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagtgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttaggcatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgtttgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatagtcatcttccatcttcactttagaggtgggggaaaagggcattagagtgattgtgtggtaaaatccactctaattctagctgtgagaaaaagagcggtgaaaatgtggtaagcaattgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccattcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcatcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaaggccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttaaagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctaactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagtctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcgcaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgttttcccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgttttttttttttcctttggatatatgaccagcagtgggattgctggatcttacgatatttctttcttttttttttttttttttttgagacggagttttgctgtgtcaccaggctggagtgcagtggtgctatctggctcactgcaagctccgcctcctggcctcctgggttcaagcgtttctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtggttttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcctctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccattctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaagggaatggtttgagacataatggtcattgtgatttttcaagctataaaataaagcatgatgttaaaagatgattaatgttttcatttggtggtagatgacaagtttcttgcagggcatctgatcaatcatgctcttttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgcgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatatatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtaaacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacccacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctagtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccacgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttctcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcacgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgacaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacaatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcatgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcgaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgccttactctcactgccatactcctttggacatcctccttctcttgtttcctgatacttttacatccccttccatcctttactccttagcttttgtttttatttgcagtgttaaagatagcctctttttatttccctgtagtgattagatcgacgtgtttacaatatgaacacacacgttttctcttcttcaggctctgagtcatcgagttcacaatgccatgtctagtcagtacttctatgtgtgtatagtgcccattgtggccgagtagagataaggtcactgcggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttattttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctaggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttctattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaagaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgcttttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttctttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggctttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactctcacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcaatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagaggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttttttttttttttttttgagatggagacttgctcttgtcgcccaggctggagtgcagtggcgcgatctcaactcaccacaacctctgcttcctgggttcaaacgattctcctgcctcagcctcccaagcagctgggattgcaggtgtgcaccacgacacctggctaattatttttgtatatttagtagagacggggtttcgccatgttggccaggctggtcttgaactcctgacctcaagtgatccgcccgtcttggcttcccaaactgctgggattacagacgtgagccactatgccaggccagttgtgggaattttataagggctttttcttttctttttttttttctccctctggcctagtttgtggggagaggtatgtttccccaaagatgtggagttagcctgttgatgtaggcatgggagagtgagcttagacagagatgcctctcatataaggtagaaagccttccatgcccaacccaagtgttgtagaagttgaaaggggaaaaaactttttcaaaattggcttgacagcaaaactcctctcagtgtcttcttttttgtccccctctataaatggtaggttttcgtagtatcatgaccctttttagtaattataaattaatataagataaatttatggtattccttactatatagatttgttaaaataattcacgatatttcatatgtacacacaagctccttcaatccaattagtaagaaaaacacttcatgtcactgttaaataacatgaaaataaacaactggttaaaaaacaaaacccaaatacaaagcgttgagcttcctactggaatctgaatctgggagtgtcttgttgtaagaaatgttttcagacctatcattttcttttgtttctttttctttttttctaaacagactcttgtcagttctcttctgattagtgttcccctgggcttttcttcccaaaataaagttaagtgcattcaagtttctgggatcttctttacatccttttgaaaatgcagagtaaatattatgttggcttctttttgttttttttttttaaattttattattattatactttaagttttagggtacatgtgtacaacgtgcaggtttgttacatatgtatacatgtgctatgttagtgtgctgcacccattaactcgtcatttagcattaggtgtatctcctaatgctatccctcccacctcccctaaccccacaacaggccccggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaactcatcatttttatggctgcatagtattccatggtgtatatgtgtcacattttcttaatccagtctattgttgttggacatttgggttggttcgaagtctttgctattgtgaatagtgccgctataaacatacgtgtgcatgtgtctttatagcagcatgatttataatcctttgggtataaacccagtaatgggatggctgggtcaaatggtatttctagttctagatccctgaggaatcgccacactgacttccacaatggttgaactagttcacagtcccaccaaaagtgtaaaagtgttcctatttctccacatcttctccagcacctgttgtttcctgactttttaatgatcaccattctaactggtgtgagatggtatctcattgtggttttgatttgcatttctctgatggccagtgatgatgagccttttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagtttccccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcgtctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttggtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtgctgaaaaaaatgtgtattctgtcgatttggggtggagagttctgtagatgtctattaggtctgcttggtgcagagctgagttcaattcctgggtatccttgttaactttctgtcttgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgcctttttttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgagagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcggctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcattcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcaagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaaatagcatttacattttggctcttgaaataactaacagcatgtcatttccaaagagacgttaatcattgataccaccagcagcaaatgttctcattcatcagaccacatttgttttacacgttcctctccttagaaagagataagtatggtttcttttctttagttcttgctaataggatacccaacatattgaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtagtgtatgtatgtgcatgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaattcaaaaatcagtcaggcatggtggcacatgcctgtaatcccagttacttgggaggctgaggcaggagaatcgcttgaaccacgaagtcggaggttgcagtgagctgagattgcgtcactgcactccagcctgggcgacagagcgagactctgtctcaaaaaaaaaaaaaaaaaaaaaaaaaaaaaaaaaaaatttcagaagtcccggagtcctttccatgatgcatttgaagggccagagagatagaggcatgccctatgtagtacatcttgctgctgtccctcgtgtgtttaccctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcgcgcacacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtgcaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcgtgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggcagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacatttttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagtcttagtattttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaacagcctggttcatttttactgtgttgccattggttaatgcttaaccagattttgtctctgtttcaaaatcttgaaataaaagtggaacaacttccaacatgacttaagaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccgttaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataataatcaaggacttagaagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggttctctatgaccttttagctcttaagtagtctgtcctggctattgtcaaccatgtctttttttccttgactgatagaaactgtggcaaactaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacgggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagccaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgtttaaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctacgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgactgtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcgagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttgtatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttccttggagaagttagggaaatgttcacagagttagagacatttgagctgagacaatataaaaatatagggcttggtagaacgtgaagagagggaaacggcattgttgatggtgaacacagcatgagcaagggttcagaatcatgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctccggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggcctctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaacgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggtttttttttttgtttgtttgtttttttttttttttttttgagatggagtttcactcttgttgcccaggctggagtgcaatggcattatttcggctcactgcaacctccgcttcccgggttcaagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataactttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggcggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggacaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaattcgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattaaccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacatactttttgatggcattgtttgtttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaatgcttttctttatcaatgttgaatattggcccccattctcttctggcttgtagagtttctgcagagagatctgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgacctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaatcctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcattacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcatatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgcttgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgcgcctgtatacatcagatatatggattgatgcagtgtactctctctcccttaatatgtgtgtgtgtgtgtgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatgtattcttttgtagtgttgcttacgttttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcccaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatggtctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacaatctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcctggcagggttatcttacgctattgaacctcagtttctccatttatccaatagagatggaaagtattggcctgcatttatttctccttcaaatgacatattgtatagaagcgtatcgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaaaatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacgattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgatttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattacaccatagcagtccagcctgggcgacagagtgagactgcctcaaaaaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagacgatctctgtcagttttgcctaggacgttcagtgggacttgggtaggagactgtggactaatctcacctctggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttactgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcacagaagcctaacgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgtgagttagatttgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcacatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagacagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgaatacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcacacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgtttatggaaaaggagattaaagaatgcagtgtgggttttttttcgtggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctgtgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaaggtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacacttcctttcacgtttgtaaactagttatagatttggtacatgtagtcagtcactgtgctaaattctccttaagaattacgtctcttttttgaaaaactaacttttaaaatagacattattattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatgcatgtgtgtgtgtgtgtgtgtgtgtgtgtgtgtgtgtgtgtgtgtgtgttacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccatttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttgcaagagtccaatgctgcataatattaataaacttaattttcttaaattttcttctctggcagagaccataagcagtatgatatttagtcatgctaggataagacctgagtagaaattgtactagctatccagctcgtttgttaatttacttttgatgaggcagagaacggtcatttaaccagcttttgttcagtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaatattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgatgagtgggttgggattaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatatgctgtgtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtacgatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaacaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtaaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacattctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatataggtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacgctccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacatacaggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatgcagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcaaactgcctggcatggtgcgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaggctactcctccataaatagaaaagatctcttctccaacacatcaaaaacattatttttaataggaaaataacaaataaagaacaggttaaaaggtagaagtttctgtttccccaatacagttttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttataagccatcctagggagctcatgaatttcatgagtgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaatggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccgtggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcagcagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggtaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattgatctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcatttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttgggatatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacgcggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtgctcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatcgttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctttggcttttccacattaaatttctcctcttggtttatttttcagagtactctatgacctacctcatcctatgtagcacactgtatctcccactgtcctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcaatctcggctcactgcaagctccgcctcccgggttcacgccattctcctgcctcagcctcccaagtagctgggactacaggcgcccaccaccacacctggctaattttttgtatttttagtagagacggggtttcactgtgttagtcaggatggtcttgatctcctggcctcgtggtccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccccagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgtttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctccttcctttccctcccttccctcccttccttccctccctgccttcctccctcccctctctccctccctccctcccttgtccctcttgcctgaacttcatatcagtgtgtcttgaatatttgaaaaatatttataggaaagtgaatgaaacctatcctaaatggagaagtagatggcaaaaaagggtattagagcttggcttttcaattgtaattgtagccatgacctaatttttggtaatctaataggcccatataatctctgcttggtgttagaagggaagacctttcaccttttgtgttttcttcctaatgtcatgcaaagtgctagagctttggagcaaaatgtttgatttccaaattccaattcttccatttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtttcaatgagccaaggttgcagtgagtgccattgcgctctagtctgggcaacaagagcaaaacccggtctataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggtgttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgctttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgaggctctcatcagaaactgtctggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctctttccataaaatgatatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacatggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagaaggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacagttgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagaaatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccgtccgtccttccttccttccttccttccttccttccttccttccttccttccttcctctctctctcttctttctttctctttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaggtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttggagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatctgaaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggttgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcactgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtgcagagaggtttcaggttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttgtgtgaacctgtccatgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccaagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgcgcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacagtagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaagaaaacagaggactattatgttactatttcctaaataaagaccaatatgataaattccttatattcagtgagaggaaagaagttgcttaccgaatgtactgatatatgcttccttttttcagaaaacaacaacatcaaccaaaacacctgtataattattacatgaatttttttttttttttttttttttgatatggagtttcagtcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatgtcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgggccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttaaaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtaggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaatattggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttatggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacacacacagacacacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttaattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatatgtgtgtgtgtgtgtgtgtgtgtgtggtatattatctatttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgtgtttttttttgttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaataactaccataatttaaaaatgcaaatgtagcaatgcactaaaaaatacctttagcttattttttgttaagaaacaagtgttttgcataatcagactttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctcctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaacggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggctttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagaacccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaacatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagacacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcgtaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgtaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggtcgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtggttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcacagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaataacaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaaattaaaaactattacattttttctccctcccttcctttctactgtttccctcctctcctctctttggtttccttccttcctttgttccttcgttccttcgttccttccttccttccttctgtccttcccttccctccctccctccttcctcccctcccctccccttccttcttctttcttgccctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcacttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgcttttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactctcattgggggttgggggggttgggggtgggctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctacttgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaactaggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgtaatatgtgacagttccctgggagtttctcccctcctcgtaggtatttttagcaaaatagtccttaaacattgttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcgtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataatttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttattgagtttcttccctaatttagatctcaagttttgcaaaagaatgacaaattcctttatttaaagaaaaatgaaagcagatctgttaccttctgtcctatgaatgccaattctctatcctggataattagataaataagatatgtataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttacaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgattttctgtccttttatatttcctccttccctctgagggttcacataggagcctccacagccagaggattactttcagaattggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaacgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcattttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcactggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaattccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatatacacacacatatacatatacacacacacacatatatatagcattcttaatctcatatatatataatatatatataatatatatatattatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggtttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcaagttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctcttggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcattttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtctttgaattaaagcaacagggcacaatttcaggagccattgctttcttctaggaaatacctcactattagagctctctttggagatgagaagatttttctcaactttattatgaattccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttggtctgtatatcttgtttttcatgccagtaccatactgttttgattactgtagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatatcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctaccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcaccatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcaataccagtaccatgttgttttggttactgtagccttgtagtatagtttgaagtcaggtagcatgatgcctccagctttgttctttttgcttgggattgccttgtctgtacaggctctttttcatttctatgggttttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaaaaaaagagagagctaacatcttcactttttaaggaaatagacattgcccccatgattgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatactttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcgaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttccctttccctttccctttccctttcccttcccttcccttctccttctccttctccttccttccttttccttccttccttccttccttccttccttctctctctttctctcttctttggtgtgctgagaataatctgcagacagtgactctacagataagattgcaaatattttcccttccttcattccttccttctttcctcccttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaataaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagaaaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcattgtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatagtcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagaccccatgttgaagaataagatacatatgctgatgtctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaacctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccatttctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggattgccattaaaataattttgtgcagcagcactgtgaggactcagaatccagaagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcaggtgcggtggctcacacttgtaatcccagcactttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgtaggagtcaggttgcctataaaggcaaggatgtgcatacagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacaatctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggtttttttttattattatataaagccttgcagtgagtcatagaagaaatgcactggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaaaggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataattcataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagatcctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccatttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagtcgtcttgagacaataggttgaagctttcactacatgttcttttagcaaaaaattataaagcatagaggttgagatgggctctggaatcagactacaaagattctgatcttactgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatctctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacacaccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgttaaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcagctcttaccagtgacttcagtgcttccttatacaaggtgcaagcggtgctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggcattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcagatatgtgtcatcttaatattcctattaaccttagaactttgtgactgtgttgggattacttgacatatttgtttatcaatcaacacagtgacagtgacaacgaatgagtaaccagtgttttgtttttgaaacatttgaagaagtgttccatatttctgaagttattagtttagtttaggttagtttagtttagtttagttttaacgacagagtcttgctctgttgcccaggctggagtgcaacagcgtgatctcagctcactgcaacctctgcctcccaggttcaagcaattctccctgcctcagcctcccaagtagctgggattacaggcacctgccaccacacctagctaattttttgtatttttagtagagatagagtttcggcatattggccaggctggtctcaaactcctgacctcaggtggtctgcctgccttggcctcctaactgaagttattttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtagcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacatcatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttgaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactcttggtgttgtacatgttgtgggctttgatgagtgtgtagcatttatttcccgtcatagaatcatgcggaatactttcactgcccctaagaattatccttgctctgcctattattactttctcccccaaccccggtaacccctgaaatttttactggcttcatagttttgccttatcagaatgtcttatagttgggaccctacaatatgcagcctttccatattgccattttactgaataatatacattcaaggttcatccatgtcttctcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttttgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaagattgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggattggggacacctgttacagaatttatactgttaaatgtcacttgatatgcacactaaacctattacaaaccacatattgtcacttgtcataattggacagagctgcaatgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccttcttcttcttcttcttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttggtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggaacagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccagcatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaagcaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacattatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgatgtgaaaacttagcttgtccagccaaactggaggaaggagaggcgggacttattggagtaactgaaaagagaaaaattggaatatgagcagtaccaatactcagtctcttaaggaagggtagagtccctttctttctgtctctgtaatttttttcttttttgtttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcaattggttttgttaacactgctgcaccgaagctctagctgaattcacataatctcatgattttagtaaaggtaacaaaggaaaacgattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctcccacagcattagccttagttatgagtataatacaaaagaagaggaccagccctgctggaaggtaaatgaaaagatggaggaattgaacgattacataacagctgttcagacttgtggtactgattagagtcatttgtagagatgaagcagtgtgtcaagccagtgtgggctagggtatactgggaagttctcacagacagaatgaagtgggttgcggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgtgtgtgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaaatatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattaatcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccgtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatggcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttccctttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcatcttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtaacaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatacgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaatactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcagacatatggagtttcaaactaacactgtggtaattgttgtgtgtctaaacaagtgacaacggggctgggcagcaaaactagacatgggagaagccaactgatccattgagctgtcccagcaagagttagtgggattatgatttatgaaagacctgtgtggacaaggtagtttggaggaactgaatggagggagtgaattaattagaagaatgagacaggactagccacaaacttctcctagaagtttaaactattttaaaaataagagttgtggctcatcaaaaaagtagtgttttcaaaaaacacagccccttcacttaaatgatacgcacagtccagatagactgcaaaacttaatgtttagaagctaacaactttttaaaaactttattgatctgatctgtactgagaacagattttctctgtgctttataataaaacataaagatcaatcacaaaataatttatcaataaattttaaaacaaaaattttaaagtgtatgtaaatatcatataaaattaagaaaaaatatgtaagaataatatttgcaatgactatgataagcaaagggttaacaactgtatgaaaattttcatgcaaatacaaatatcccaacagagaaagacaaggaatgtaaataattcttaagtagataaatacaaatggatatttaacttaaaaaaaattttattcacattagtatgaaaagaaaatttaaataattgaaatctagtttttcacttatgaaattagcaaagatttaggaaaagaaactactgtcatttgctgctggtaagaccgtaaattggcccaaaacttttagaaagttattttacaatatttctcaagaactttaaatgtctcatatctgtcaatccagacagatagatggatggatggatggatggataaatatcagatggatggatggatggatggatggatttatcagtaatagatacatagatggatagatagatagatacatagacatctatagagatatatgtttctatataaatatatatctatattatcctaaagaaatatatatttgaacaaaatctatttatgaaaatgttcactaatgcaaaacttataatggcaaatagaaagggaatctgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtacttcccaataatcagattacatgtgattttattttcccccctaattttccttaattttcaagttccgtacaatgaacatgtgttattttcataagtataaaagacttttttataaaaagaaatatatagaactaattagccaaataggaaagtttctaagaacaagggaagaaatttgtgaatggagtggtgaagagatccttggactgagagctgggcaatgtggatactaacactggctctgtcacaaagaaacaaggagacttattgaggttctctcttctggctcaaagattttatgagccagtaatttatcaaagagcccatcctagtgtacccatgggcctgtcaaccctggtagacaggttagtagcccagatgaaatttcccgtggatgaattttagaactccgctccattgatcacccttttttgttgttgttgttcttttactcttctggaagagagctaagaaacttctgataccatccccctttcccactcgccctcagttgtgagatggaggcagcaaatattcagtgtgttctttttggtcttaagtagttctagactcagataccacctcagcaccaggctgagtttgggctggctttggctacggtttgctgctgaatgtatcagtgatggacttttgaatgtttaatagccttagggaatgtggcagtgtcccctacatagagaactgtagattctttagtccaccatttccaaccctgtgatttagattgtcattataagcatcacaggatgccctgagttgagaaaaatctgtgctgtttaaatggtctttaagcagcctttcctttctcctctttctcagctctattctgcttaggatatggcttatgccacttaatcaacatgctatcatatgctttctgcattccagacatatattgaaatatcttggttgttatagccatcttctcccacatacatcccctttctctcttcccctctacatttttttctgttacttgttatttttggtactgatgtgcttttatttgagtaggatattggaatgcaattgtcttcttagtccaccatcccctgacctgtcattattgaaaaacaaaattctgtagcaaatgagtccccgaaagtgttttttttcaaatgatgatgatcggtcacgttgtgaatctgtagactcctttgcgaaaacaacaataaacacagtattatttatggtggatatgctaggtacatccaaagctcttcatatgtgttgccttgtataatttcctcagcaactctaatttaatagaaactattgtccatgtatagatgaggtagtttatacccagataggttatacaaacctgtaagtaacagagccaaattttaaaggcagacaatgtaactgcagaaaccttgttcctaattgtttaatggaatatggtttagaattctgtgtggagaatcttactctaccctagtggtaaacttaaagctctttaatttactgtggttatattatatatgtgcaatggatccctattttcaaacatagtcgtttgataaagtgtgggctgcttttcatcacgaatgtaaaaagtctcttagttgctacacccagcaactaagtgtcctttaattcttaactttgaatacttaattggatccctggtgctatgtgtatttgatttttgttgtgaaagttgcattcactgtgtccctttatttgacatcagcaagatgtaatttctataaaccaattaatgatgcacctttcaactcttactatgagaatattagctggtgtaaatatcggactccttgtgaaggatgactcgctatctgattggtctttaaaaaaatactttaggaaataatggcttgcccctgcatataccaatttgaagtctttctaatatcagccattagctgggatccacatggagtacatagacaaatgaccatagtttctactgtaaaaatgcctcaagatcttgtaggtgagattaggcaattagataaatgcctatagcacaaaatgaattaacatgattgcttgaaaagaattaatttctgtaataatttgaagaaggaagaagttatgtatgctttggggggtatacagaaaggctttataaacaaccctatgaaaaaatggaccacagttttaaacgggcaatccacagaagggaaacactgcaatattcattggaaaaagaaaaggaaggaagggagtgaccaagagaagaaacaagaaggaaaggactgaaatcttgtttgcctttttggagaagatagcatttgaaatgggccttggataataaggtgtgattgtcgttggtggaaatgaattgcatccagaatgcagaaataactcaagcaaaggcatagagattggaaaacatggggcaggtagaaaacaagtccagagtctttgctgcttcttagaagatgtataagggttttattttatagttttataatgaagggcttttaatttcaagtgatgggtcagtgtataattccttaggagataaaattccagggaaaaggaggaggggttataagataaatctagaaatctaactcataaaaattagttcccttccagggagttagttactccaaaaatatccttgataagctaactctgcatggatataactgtgttatctgtgagctggctacagacaagaatttacaattgtctgtagttgcagtctttgagctgcagtcattcaatctctgtctactgctaaaagccagagtttggaaagagcccttatgcatgcttgataatgacacaatttgactgagaatactgccattttataataatctctgaaagttacttccttggtctactgaatctcatattttgtgaagttaaatgaccaatgactgtcattcattggccatgattgtcttgagtttgttgatactaaggtgttatttataatgtgccttttgtttctcaagaatatgttcgcagaaatcaccagtagtgttatccatgtgtatggaaggccagactgtatccccttatgtactaacagactgtatggcaagaagggagccaggttgtcaatgtgagagctaatgttgatatcaacacaggcatcagaaagtcaattactctgtttccctagtttactaaatggtgcttttgcaatagggaccatgttgcctaatgggctgtgaactttaatttgttcataacagtgccaatgagtaaatggatctacctgtggactttagagtgtacttctaacattttaggactgcaagaaagtagtgtgttttatcctctgatacattcatattctctattggagcatacctatccaagcccaatatcctacatcagttttaataaagagaaattacatttaattgtgtctctatcctttcatattaatccattatgaatattttattccacaatgttagaaaaattacattaacttattagtgaagaacattcttttataagaagtgctttatacttcagaacctcataacttactttaaatatttcaggcacaataactggtaagagatgaaaaataagcctgaactcatagggtaaggaccatttagaagtcttttgtcttcagcttgtgattgttcagttaaacttatttgatgtgtgctcagcaggttgtaaaattcctatctttctggagtgatccataagagattacttcatagtgaaacacttaagtttgattcttatgagttgcaaaatgattttccaccaggaaaaataaagaatatgggttccatcaaaagtcaggcatgaattctcatctcctgataaaatgtgaaatatctttgctgatcctgtgcctattctcagtttccatgaccatgcacaattattatttttagcaaataagcaaatttgaggcaaaaacattaatttgataagatatctgcaaatgcctttctggaggagaaaataaatttaaaaagcatcagtgtgtttcactgatatgcacaatcccccacttcttataagaaattaaaacactagtttttaatatcttcagagagaaaatgagtaaaggaagcacagtattttccgaaacgtgttatttaaactaaaaccatgaaatttatgaaaaaaaaaaaaagtagacccttccttgatacacttggtcccaccgaggttcaaagtttcctttgaattggggggggaagggagattctgtaatttaagttttaaacttctgtctttgtatctatccttgtgctggtactccgctatcttggttgctatggttttagagcaaatcttcatatcaggtggtctaagttctccaactttgttcctcttttccaaaattagttgaactattgtgcatcctttatatttccatatatattttagatgtggcttgtcaatttataccaataaaggattctgttgtacatgtaaaccaaattagggagaactgacactttaacaatattgtctttcaatgcatgaacatggtatatctctccctttacttcatttttttttttttggttctctcagcagtgtttttaattattattgtaaaggccttgcacatattatggaacaaacacatattatggaacaaataaatgtaaaagctaaatctataaaacttttccaagaaaagaaaagaattcttacaaccttagataggcaaatatttcttaaggagtatacaaaaaaccccacaaaccataaagttaaaaatgataaatttgattttataaaaactctaaaacttgttttttaaaagacaccataacaaatgaaatagcaagtcccatacagggagaaaatatgtgtacagtatgtgtatatgacaaagattttatgccagaatatagaaataattattaaaactcaagaagaagacaaagaatgcaatttaaaaacaggcaacagatttgaaaataggcaatagatttgaacaggtacttctctaagaaaatacacaaataaccaataagcaaatgaaaaatgctcaatatatgtagtcattaaagaaacaaaataaaactctgtaaggtacctccatacattgatgagagtggctaagactaacaataccaagcattagctaaaagacagagcaattgaaattctcatacactgcagttgaggatgtaacatggtactgccactttggaaaacagtttggtagtgtcttaaaaataaaacgtgttcaacatatgacccagcaattctcctccttgacattgacccaagtgaaatgaaaccttttttttacacaaaggcttgtacacaaatgttcatagcaactatatttataatggccaaaaactggaaacaacccaaatgttcattaacaggtgaaaggacaaattatgctatatttatacaatgaaagatgactcatcggtaataaataaatgatctgctaatatgcacaaatacatgaaaaaaatcttaaaaatatgatgctgaataaaaggaaccagagctacctccacccctaaaaaagactgcctaccttagaattatatatttacaaaatcctggaaaagacaaaactaatctatactgacacaaagcaatcagtggtttgctgaggctgggagtggggaaaggattgattataatggggactgacaaatagggaactttttggggtgatggaaatgttccagatcctggtaatggaggcagttacaaagtcttataaatgtattgaaattcatcaaagtgtacagttaaaatggttttatttattgcatttagattatacctcaacaaaggtggttttaataaataaacaagaaaaagtgtttttcaccaattggtttgaaattcggccaaggcatatttgagcgagggctgtcagccttgtatttgttgcaagtcacagtgagtatgtcctaatggatcctctacaaggtccaggttaggtttctttaaaggatggcaagaacctgaaacagtgtgagtgcagagaacagtgaaacagtgtgtgtacatagtgctttgatttttgtgcattttttggtcctaatattttaaagtttgctgaaccatacctcatagaacatttacctgctttttctgagggaaatatctttatagaacttttccaaagcattctgcatagattttattttaagaaattaaaacattttatttgtattaatttacataataattggttaactcacataattacaatgacaagatcatacagtaggagcagacttgggatcaaatgcagctgactctaatagcaggtgtagcaggaggcacacagctgaggggacatttgagacgaaattgaggccaggttccacttcacattgtactagggttaagcgtgtccacccagaggaagagaatccttaggcctaaaagagcaaaagtgtacagacatactcaagagtaagagagtagccaggaacaccagccaagccataaactccagtctgtgtgtgttaacagataaaattaagagggtaatctagggagtctattgctaaatgaagggcacattaagtctcaacagtattcctatgatcaatcaagcaaccaatgaagtgtacaagcagaagtgatttgtcatggaatttcagagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtggtaagaggccagttttcccatcctcatttactctaaatttgattcatagattattgagcctcagatatctgtttgccatctggtctggtcagtctggtttggcatgcgtcttctttctctttagagtttgatgacgttttaggctgtgaggggcatttgcattgtagtagaaattggatgatgtcagacttgctttatcacactttctcaataatctcttttggtgagtttgatattctacttacagctgctaaagctccttataaccatacgcacaaacatacacttccatatagtcatacatactcacaaacatatatacacagccatttacttacacacgtgtacacaaaggtgtatatccacacacttacatgcacaatgagagatgcatagtaagaatttttccactacccctagtttaactggaagctgtagaaaatctgaactttattatattgatctctgggatcatccacaaaattgcccaaaatgggaatgcggaagctgtttcttacctttcattttctccacatccaatgtgtcctcttcaactgtgtattttgaaacaacctttgaatctgtccccttcccgcaactgcactgccaactgctgatatcattttttgcaaacaagtgtaatgaaaagagcatattctttaacatcaagcaaactaaggtgcaaattttagctctgcatgtattcattgtgctatcttggacaagttatttaactatcctgagcctccttgtcttaatgtgcagatagaagaagataatgcctacctgataggtggcataggaaaaggtcaaaaacattattttctactcccattgctccccttgcctgaaacattataatggccaaacaactggcctcccaacctcctttcccctcttcagtttttcctctacattatagctagagattttgctaaaatgtatatatggtcatcccattttttacttgaaactggtatcttcctgcctataaaacacattttgtttcttagtctcacataggaaatcctttttagtctgtcttgggcccaggactccagtccgattttcctcccattcctacctgccctcttggttttgaatgttccacacaacttcattcctttctctgttaattggcttttcctttacttagaatgctttcccccttcctgctttttagggagaacagggtaaactgttctccctatccttcattgagtctcctttcttttttctaaagttttttcttatcagcatccctcccccaatttgagctcattttctagaaagaattaatagctttcttatatgactctcaagatatttctgtgtggttctctaacagccttcatttattttatatggtaattatagatgtccatttgttctagggaaggcaggtgtcaggtcttactcatctttatattcctggtttgacatacagtgcctgatgtctagtaagcacttgatatctgtttattttaatgtttatgccctacattatctatcacaagtattaaagattgataggtgctctgtaaatgttaaattgagttaattattttcaatcttacaggaagttacataagtcattcctgtattcatttgtgaattttcgacatcctatattaagagttgcacttagaatgtgagttccatgagggcaacagcacttctgtcttactgctctgtctgctatgttggcccataattaaccactcagtaagccttttgtgaaaacaacctcaatgagtcttctacctcaagtcttttgaataggaatggatttaaagctgacccctaatacatctttcaaactttaagtcagtaaattttttacaaacttttttaagttgataaatccctcagaaattattctgaggaagctgatgggatagaaatgaaacagactaaggggctccaggcaatcaccactccccttcgttctccttcctctgttggtggggatcaatagagcaggatcctcaaaactgtggagttctttggagcatactttgaaagcctctaattctattccacgctctaatttccaaaagagggaactgaggcccgtggtggttaaatgccctttccgaggttacacagctatacatggtagagccgacccatgtcttctgactctcatcccgttgcacttacaactagcctgcatgttccccttttcccatatcgcatggatagcatcttacgcatctaagtttttttctttaataatgatcttctcttttctttaagagacaccatcactccgagttgtaccacttgcaccaggctaaattattcctcagtgtttacccctttcagatatttatagaccatcattatggcactccctagtcacctgtcagcttcctaatatgtacatatatggtttctttaatctttctgtacagtcggcttctctagtcccttaatcatttgtaccattctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgtaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaagaaaccgttactgagcgtatccatttttatgcagtttctgtggacttacatggtttctgggagctccctataagccttagtaagggaaagctcttgacttatctcactagttattagggatttggatatatgtttactaaatgtgataatctaagtatggaaactacattagtacaagaggaatcacccagaaatactctactggcataaataaaacattacctattgcccagttttctcatttgtttcattttgtaacttttataatgtgtcaataagtttgaagtcttgaagggctgcccagaaaccaccacagagtggattttccttaccctcaatctgccttcatcaaaatttagtttgtgtgtttatcctataaaatttatctcataataaaaactgaagactaggacggtccttagaaaaacacttgattcggtgtatttattttataaaagggagtcacagagagaaaatgtggccagctcaggtacatggcttcctaggcaatgttccatttcgcaaaactttcattggtccagaaagtgtaccttcattcccaaccaaatccttcctataatgctttccatgcctttcttctgtggctctctctgatgatctcacaggtctataagctcttacaggtagaaatatgatttcttgctgtgttcttattataaagcattgccatgcaactgagaagtaatgagagccagtggattttattagaatggaattttaacttttctactttaaaacccagtgattctgctagtctggaggtagcaaagaaggatgactattttctctctcacacaaagtaagattctgaaggggcttattctctgaatgaaaaacgagaggagaaaagtaagaaccttctaatgttttattcaaatgttaacaaagaaatttgagaagcatgtttccttaaaattgacaccatttttatcccaaacattctggtaagtgatagcagatgactgtgcaagcttctatggagagagagagaggaatttttccaggagcatagtcccagtgggaagtattacctaaaagtaatacactaatcactttcaatcttgcatatttccacatactgtgtgcacacatatgtgtattaataactgttccctagacgtcacttcagcgctcagacagcttagtgttgctatgcgaatgctggagatggaatcagatgcagactacagtttagcaatgagaattcttcagagatacaagaatggaaatggccttaggtcctgcctcatgggtctccctctgagctccagtgtaacatcgggtgtcaagtatttgtggccccatctgcccactccactgagaatctaaatggcattgccagtatttgtgaggtactcatatcttaaaagtcagtgtactcaaatcagtcttgcattctaccttgtggattttgcatggaaattttttagaatgtcattgctgatggaagccccagatatataagtacatctgctccatcgtactggtgatttttatagatattcataagaaaatttattttacagcagtttattttagaggaattctttgcattttatttgtatgtgtgtatacttattttactggcaggatacacacacatgtatatacacacacacacatacatatatacacatacatacatatatatatgaatgtatgtttgtatcctgtcagtaatactttgaggtacctagggctgagattactatttctcttccacctatggctcaaatgggtaaaatagcttactcaaagtcacagttcatacatgtggtgcagcttgaatcaaaactcaattcttctatccacagatttaccactacttgagtagtctgtggtgtttaaaaaaaataataaacaacaggccgggcacagcggctcacacctgtaatcccagcactttgggaggctgaggcaggtggatcacaaggtcaggagtttgagatcagcctggctaacatagtgaaaccccgtttctactaaaaatacaaaaaattagctgggcatggtgacgtgcgcctgtaatcccagctactcgggaggctgaggcaggagaatcacttgaacccgggaggcagaggttgctgtgagccaagattgtgccgttgcactccagcttgggcaacaagagcaaaactctgtctcaaagtaataataataataagacgaagaagtaacaaagccaaactggaaagtttctgttaaatgaatgttctagataataccaacgtataaagcaatcattttataccagctatggtcaaacagggaccagagccttgacttttttttgcctcaacacagctctgcagaacccactcagtaccccatgtcctactgccattcctttggtttccagaacattgagatgtacaaatccaaaacaccacagtgtttcagagagaaatggcatgactctactggttgcaattgtaatggagttcaccttgttctggagtcatacagaagccatgttgtagacttagtgtcccacgcaatactcctaattacaatgaaaatctactgttaggtagaaggagaaattcctcacaatcaggcaacagcgcctactagtgggaagaaactgatacttgaggtagggcacctgggagatagctctgtgcatcttgagagagtgctacactgagagcccaaaggctctcaggtctcatctctcctgacagcttgctatgacatcttaatcaatgaattgcctctctcttaccctttgttatagagtctgtaaatgaagagtttggaatggctactttctaaattttctacacgtcctatgacccttgaaatcctcttaacaatgtattatggatactttgctactaaacggtaaaacagaatcccgagtaagatgaattggcttcctaaggaagtagtgtcaggggagaatagcaccatctttggggccagttccatttatgcaggtaatatggtatggtccagctcaaagatcactggactgggctgagttgcaactctgctacctacttctcaagtcatgtacaaggtcattcctatgttaactcatgtgttgggaagatgataattgtctcatttagcttttagttattataagattcatatgagaatatagaaattatgaagttttatgtgaatctgcaaatttattttcagtctttatatatcacaattttaatttaggctaattataatttttattttcccctttttgttctatattctaaattcgtatctcccatggaggcaggtactgtatggacaaaatcttttattagtcacatattgttttcatccattttgtgctgctatagcagaataactgagactgggtaatttataaagaatgaaaatttattttatcacggttctagaggctggtaagtccaagatcaaggcaccagcaggcttggttttctggtgagggctactctctgtttccaggatggtgctttgtgctacctcctcacatggcagacagtggaagagcaagccagcagaatgccgcatgaagcctctttcacaaagggctttatcccattcatgacagagaagcccgtatggcctgatcaacactttttaataaaatcacaatatctactgctgaattttggagggaaccaattcaaatcatagcacacatcttttctaaaatggaaagggtaatatgatcattggagaaatactcattcctttgcatattggtttactatccaagccaggtgtggtggttcacacttgtaattccagcactttgggaggccgagatgggtggatcacctgatgtcaggagtttgagactagcctggccaacatggtgaaaccccatctctactacaaatatcaaaaaattagccagccatggtggcacacacctgtaatcccagctactcaggaggctggggccagagaattgcttgaacctgggaggcagaggttgcagtgagccaagatcgcaccactgcactccaacctgggcaaccgagtgagactccatctcaaaaaataaaaaaaaaagtttactatccagagaatcttgtccaggttaacactcttttttgtctgctttcttcttttgtgaaacaagaaggtaagagggacactggagaaaacctaatgttctttacaaaatgagtcatagttctccatctgcaaactgtggctcccatttatgtcttggtgtcaatatgactattacatgttatgtacatggattccacctcatttgcaacatagtcttctgcctgagctctgtttgttggatctgatctaactttacatggtcttaagtcacacattgaactcttaagttctgtaggcctctaagcctttttaagttttagtattttcatcgttaaaatgagagtgattataacccttgctttgctgcctccaaatattattgagggatcaaatgcattgataaataagataaagcactagacaaatataagggatgcttgatgacttcacagagggaagattattctgttgctggctgctgaaatacagtagctttagaaaaacccctttgggttcccttattatcaggtttggtctcaaataaccagaataaatttggagatttcctaccacaaaagctaaaagtacctgggcagatttaccctttgagtggacctaagggaaatgcagattcccacgggagagatcacggagcagattcaaaccataaggcaaaaataattgttgcaatagcggttctaactgtactagtaaatattgatttttctgttagcagatcaatcatgaaatgaattctaaatatagaagactggttaaaaaattaagacggagaatgtgaaaatgtccatgtgtaaaaattaacttaaagagaaatcttgctttggccaaaagaaatactactgtttctgtcaggaatgttctgtgatttaatcaagtttcctgcctggccagataattttaggaattgtggacttttaaagtagtaagtcagtttagaaaactggttaagtggacagatgtaaagtcagactgcctaagccccaattccagcttcaatatttaactctgtggttgtgggcaaggcacataatctctttatgctgccttttcatcaactgttatggagataatgatagaacctacatcatagagttgttggggtgactacatgagataatacaattaaatacttaacacctggtccataaaaagcgctgaataaatattgactattatcatcaccccggggtctacaaatttttgtaggattaggattaggattgaaatttctaccgaaaaattccatcagtaaaatattgataaatataaatcttaaccaactgcctcagagacatagggacctctattttccactcattgactgtcatctttagagaacagtccaaagcatgtgcctttctgttctagttgttatgagctctttattttgaagttgaactatatacttcctatagtttaaaggagaaagaagtaggtctcatgctggacaccttctagatgttacctcctccgaatttcatagccaagtatttaaggcagttatgatcatctccctcttagagaagcctagaaaaggttactgcagtgcttgacagcaaatagaaactcaccaagtgcatttgttgagggattgacagaatggctggataagtgactcaactaagaccacttatctagtgagtgcgtctactcagctgcttgttttgaagacaaggaaattcgggctcagaaaatttaggaaacttgtctaggctgccaatagctagtaacaaaggcaagaattgcatatctgattttctttacaccatgttacatctaactgttcaaaagataaccatgtattatactcgaaaatgcaaaacagggttgttttttgttttgtttgttgtggtggtggtgatggtatttttgttttgtttttgctacttttcctgagagtggaagttgttatcaaaaagttactgtcatgactactatgtgtatagatgctattagtttcatcaaggttgggaatagggtatatgttgcccaactttctgcccctctccgcctcatattaaagttccagtttcctagaatatatctcctgggagatttggcactagccatcactgcattccaataccccgggacaaactactcttggtggaacacagaagcatacagtccttgttacagcagtggttctcaaactcacattcctgatggaaagctagagttgaagggtcaacacccaagagctgcagtggaggaccatcacctgtcctgattcgccacctgtggtagatcatgactttcactaagatcccctgaggcttgtggggatggagaagtgatgctggactggcccttcctctttccctgcaggtgttaatgggttctgctcctaaacaatactgatataggtcagagttatgattgaattgtatacatagaaacatgtgctgattgagaaaatgggctttacaagtcagacctggttccagtctcagccacactacattctgcctttgagactttggccaggtgatggaacatcaggtttcttatctaaaaaggagaataattggttggtaggactaaatgaaaaaatgtatgtgaaatgcttaggacagtgctgagcacagataaaaatgcacaataattttctattttttgttagtttccttcacaatacatatatttacatcagcgaaacatgcttgcttttgcaaccttctgtgggactccccctcctaatttaccacctcacctgaaggtctaagctaagcaaatctctgtctataaatgaatcacatcgtggttagactttataacaacttccccttgccaggagatcactcagccttcacttcatctcatctggtttgctgcccaggcctttatccactcattcctgaactcctctccctgacaaccttggggttttggcttgttgtgtgcgtgtgtgtgtgtgtgtgtgtgtgtgtgtgtgtgtgttttgttttttgtttttttttactttaccttaatttctctttttggactaagatgttaaaatgtttcttaatgtgactgtctccgaaactgttttgtgtctaccactcatcctagtggcagtcattgatccttttcttgttgcgagtgtttgagtgtgggtgtgtgtgagtgtgtatatgtatttgtagagggaaaaacaagagagagggaaacagacattggagccacctttcccccactagccacgtacctgttgaaccttcaagcctctctatagaatcagatatacacaagcacagtgacagaactacatgtgtcctacagtccagcttttaagatatgataaaaactcttgtattcacagagctaaatggcaataaccataggagattgcatattgctacattatgtaaagacagagtcccaagaaaatagtgagaactcagtttgatgtatgatgtgatatgtgatatcttactttacatggctaacagttgacattctttgtggattctatattgtctaaggctacagaagagccatatgataaattcatcggcaacccaaaagaagcctgttctatcgcagtgcttccaattaatataagtaaaccactttctctggctcaatgctaccaaaatattttatgagaaaatttagctgattctgctcatgtatattttcaatggatggaaagccattgcaaacttttcaaactaaaatataaagatagcattagggagaatactctctctggtgaaaaacaacatgtattatgatgcgttaggaatttctttttttcagccaactcgtggttgagcagtctgtccccaaactgttttgcatgcggacgaaacctgtttgggcgatacttgtcagcttttcttctgacaagcaggacagaaataggcacccccagaacactgagtttgacttgactcaacatagaatcacctggagagttttaaaagtttctctcctgtaatatcccacctccagaccaatgaaatcagaatctttggagttgggaaccagggatcaatatttttttttttaagtttcccagatgattgcaatatacaggcaagattgagagtcactgtcctagagtataagcagtttaagaaacaagttgtctattattacatgcatcaatactacagagtccatgaaataaaagctttggtgataagaaaatgccaccatcctagagccttcagttaacatcatatgggcctgtcatataaagaatgcaaactcattctgttatctttttgggccttcagtggaagataatttttaaatcagcttaatggaaactgtgcttcaggaaaataacttcagtagccatatgtaggataaactggagcaggttttgtttctaggaatatgttgccatcatttcactacccttatataatcttattgattcaacttttagaaccaagactttttgcagaatatatcgaagaatgtgcttaatgggaatgctgatatatcatacaattggcatatagagcttcagttcattatcatatttaaaggtacaatattaattttgcttgtgcttaaaatgtctattataattcaagtagcaaggaagacataaagaaaaatgtgacctggctttacatctgcacatatttaatactttacatttgatggtgaataatgggaaagtttgggagtatgtcatgctcagtcaccatgcatcaactcccaaaatggctgtggacagctttggtcctgcctcaaaacaagcactgcttgcaaaagagggtctgtggcttatttttatcagttgtgtggtgatcacaggaaaaacattttaaataaaaagtttattttgccatcatgaaagaaacaaattcatattaccaaaagagaaaataaatatgacaacccagcctggtgcagtggttcatgactataatcccggcacctcaggaggccaaggttggagggttgcatgatcccaggagcttgagaccagcctgggaagcacagcaagaccctatctgtacaggaaaatattaaaaattagctgggcttggtggcgtgtgcctatagtcccagctactggtggcaagggctgagggaggaggatcacttgagcccaggagttcaagggtgtagtgaaccatgatcgcactactgccctccagcctgggcaacagagtgagatcctgtcacaaaaaaaaaaaaaaaaaaaaaaaaaaaaaaaaaaaaaaaaaaaaaaaaaaaaaaaacaaagaaaagaaaacccatatcacgctatgccacttctcttgttcaacctgtagatttccctggaatgccactattcacccatgccatccccaaaaatgacttgttaaaattctaactcttcagattagctccattattaagacttctgtaaagtctttctgttggtaagaggaggtaaatcagagatatcagaacaatcaggaagccattgcaatagcctttgaaaggaagggtgattaggtagtaggcatgtggtggaaagcaggcatttctgacacattgctgaggttgctatagatgggagagcagaggtgaaggataagaagaattgttggctgaatctagagtcagtacaaagcaatatataaaataagtaataatatataaacaccatttttggttttgtttggaaatcttaattcactgacaaagttccccatcggctgccggccctctgtcatcggatcttttgattgactgactgctcagcattggcagcaagctcttcacaccagccctgggtctgagctaatcagctgtgtttccttcatgctctgatgccttgaagtttggtactattctcctggtttctcttgtttaaaagtgctgagatacttgtctaaaagatgggccttaagattgtggtgtgcttttaataatgtgtggggtaagtgcctctagaggcaagcatacactatgcttgagtaactttctctccattctgaatctctccctaaaggacacagtttgtaaatgtttgttcatgtgaaaagggaagattcaggtaccttttctgtcctactgatgtgtggggctatttttatgttttgttcttcacttttttctgtacttgtgatttaaaggtgccagactggttaccctcaaggctagtgtccccactgtatcccaagaatagaaaaaataatgagaggcagcaaaactggcctgtgtctgagtccagcatattaggctgacccactctagaggaatattctccaaagcataaagtagaagatcattccttaggaatacaatacagtccatctgttttcatagctgagaaggcaattccgtgtcatgccatcatggagccactgcagtgttttggtatccaagccatagtcactcattctctccgtgagggaaaactagaatgtcttttcctcttccacctttacctttcaaaattccatccttgaaggttcggctcaaatgcttctttctccacacaacctttcctgagcccctgtgagtgtggttttccttccacattccatagcactttcttctaagacgtgttacatgctttgccatgtgactattgcatgtaggttgtcttgactgtgagaggcactgacatcgtgacatcgtcgaattcatttttgtatatcacacagaaggagaacatagtcgtgggcaagagtagatatttgaggttgaatagatggaccatttcaaagcttatcttttcagcctgacctttaaggctttgctctggccgttccctctaaatcagtgattgaagtttgctcccagatcctcatgagtagctatcaaactctccataagccatgtaggctcaggttcttggattccaggtattacacttcgggcatcatagtctgaatcaaaattgctacttttagctgcttagtagactgccattaccaatagtttaatgagaactacttttttaggggacggggggaagtgtggtccacagatccctgatagcccttcgtgtactatgtagtgaatctgcttgacatctagaaaagggaagagtaatatagaaaaagaattttgttgacctgcctgcatttaacaaatgtaaaatgtaaaattacagctttcacaggaatctaatatgcttttaataatcatatggattggtaatccatttactcctaatccctaattcgttttctgcaatgaaatgttgtcaaagggtggcatgaagctgttagaatttaagcatgattttcaaacatagcacattttttttgtggttttgtttttttggttttttttttttttttttttcagaataatttcaaaaatagtgccatatgaaatagttttgttactgttggcaggaaagtccaaaatgttatctcataataaaaacaggtacaagttcagtcttggataaaaacttttgaagtctgccacaaacaaatactatacaaaattttttcatcaaatgtcaagactgtggtatcaagactttataatgatatcaactgtagtggtgacagcttagtttccaatactttaactctttttccagcacttcatatttctttttggtttgagatgaagtctcgctctgtcacccagctggagtgcagtggcgccatctcagctcactgcaacctctgcctcccgggttcaagcgattctcctgcctcagcctcctgagtagctgtggttacaggcacacaccaccacgcccagctattttttgtatttttcatagagatggggtttcaccatgttgaccaggctggtcttgaactcctgacctcaggtgatccacccacctcggcctcccaaagtgctgggattgaagacatgagccactgcacccagccttcatatttcttattccttaggaaaaaaactaagatgtatactttgggttatatttaaagtcacattcaaatcccacaacaggatataaagaaatacttttcagggccaaatacaactggagaggattagaaataaatttacctttttttctctcacgttgaaacatctagccctcccatgtttgagtgtgaaatggctgtcaatccaatgtgatggagtgctgaaagccgtcttcagtgagaagtctctccataatgctccctaacatcagatccatgttaatcctgatgcacagaactgggaataggtaatatagcatagtgtttaagagcacagatgctgaagttagactgcttaggctggaatttagttaaccatttgtgtgactcagtttcctcatctgtgaaataggcataataacagtacctgcatatagactgttgtgaatatgaaatgagttaatatatctaaagcccctagaaaaagtctgacatatgtgaagcactacatttgctataccttatctatcaaagcctacagcttctggctaacattcccagtgttctataattattagatagaattttttttaacttagtagaaacaaagactaagaagggaaactagatgtggacgtgacgtctagctcaagattcccatgatggagccacatagagatatggatggcaaccagcataatgcctctcactgacataactatttgtctgaatttatattttattgttattatttaaagcttactgcaaattttaaaaactgaaacctgatgtccatatgtaggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggtaagcagttagaatgaggaagcactatggctcagtaggagaaagaaccttttagccatcaaagcgatctagaaattaaaggactgccttgggatctgcctgtcactgagagctggctgcagaggttttacaatcagggcttttgtaaaaggaactaaaatttgagtttggacccaattatcttacattctaactggatgtgtagaatctccaagaagaaagactcttctgtactgttttatagattttgccttccactccaaacatcctgagtcatgttccttttatacttgcatgtgagatgagagtcagagcactgacctcaaagccagcgaccgggttctactgttcctttctgcaagaacttagactatgagactcaatcccctcaaccgattaatgtaaaatcccctccatgccaatcttgcagaggataggggtggctgtactggtgatcttgctggggtaatggggtaatagtactggggtaatgacggcaggagtggtggttctattgctgctgacgttatgaacctgctttctcctccactttggctttagcaggactgaagtactccttggtgtgttcttatcaaacccttttttttccaggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattgtaagttccagatttgttcctcaagcactttgcaaagatgtcttctgtggctgaatgccagtcactctagatagaatatagccatcagatctttgcttcttcctagacttcaaaatgtgtgtgtggggtgtgtgtgtgtgtgtgtgtgtgtgtgcgtgcgcgcatgtaaattagcatattgtaatttttttctacacatcccccattcataagcagtcagaaaggtgtattagcatgggactgccattcagttagtggtctgctgggaagatcatcagcctgtggctttctagcatgtatgtacaagctaaaattttctttcttaaagcatcagaaagctttccaagtagctgagtcacacctcttataagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaactaaaaaattctcagtcatgttaccttagcgttttacaatgctacttacttaatctacctgttaaactattctctggtagagtaatttgatgaatgaacacagacttttttcatctattgtaaatttctttgctatccttcagcatgattttaatctttgtttaacacatgttgatgggaaaagtagtgttttttgtttgtttgttatgtaaacccacaaaacagtcatggtttgtccctcagtgcccagagatttcaacataaaagacaccttggtttctttaccaaggtattgggagtcatacttggctttacaaggttcacatttattgaagacgtttttggcctggttggtattttcctataacttggcagctctaacccattgtaaccttggggtctgtagcacagatctgaaagttcatcaagattaaggcttcgtaggattaaatatggctttgcatctgtcttaggttcaattttatttcgttttctttccaaaggtaacttaatacatgtaacatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatgtactgttgatctggaaggagcaattatgcataagcgaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagcttgaaatcatatagacagtattgggaaacagtgtaacagggtgggaagaacatgaatttgaatttcgttacgtcacttagtgcctcccctccttgggaaaattatttactctttctaagtatcagttgcctcatctatataatggggacgatggcagttattttccatgaagaagaaatgagacaatcctagtaaagcacactgggcctcttcaggaaaagtagtggaataaatgttattctgggattaactttaatgatgtttctgaaactgtttaatatttctgaatgtgggaaccttacatgtgcagtgaaattcactgggctttaggaaattattataacctttcagacatactcctcgcatttttacatgtttgcttgcttttctgagtgcgtaacaaaactggagaaggtctaatctgattaaataataggtttctacagtgtgtgggctcaagtttctatctccattccaggcatagtatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactatgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaattctctttaatcattttacatattttgttttctattttttatttattaacataatacaaatgttcatatagttttgcattgttagtattcatttttagatttttatctgtttagttttacatttagattacacacttcattttaaaaccatttgccagtcaaaatgtattgtgtgttttgcaatcttttagaattgtaaataacatgcctatagatagttaataaaaattttattttttattttgaattacatccttagcataaattctttgatttatattaccaaatcaaatttaatctggaggacttttgcattaccttgctagatttctttagaaatatttttctaatttacagaaccatcaacaataatgaaactatatgttaaaatgcaaactatcccctatggcagaagtttatttatattttctgaactaatttaataagcacattatgtcttagttattttaagtttgtgtaattattagcaaaatcaatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataaggaataagcagttgtgatattttgtatacatgaaattatttactaatataagtgcttaatctgattaacagaatttttatcattgctttttttttcccctttagtataatgtgatacactatagaaaccctctaaatctggggcaatttcttggctgtagttgctatggaaatactgaaataaataaatgtcatggaaggaatataaggacacatattaaaagcggaggttcatgctttgcttaagaagatttttatgttggtatgaatatgaagggcagcaacagtgcctcctgcttatgtacccttctgcacataaagagacagccttactcataagtatagttttagaaaaagaattgctgttttattcctagcattaccaaggagtctgggcctagggacagagtgcatcagaaattctcagcaaaagtctatttatgaagtggcagccaaggatcctcccccaaaccagtgcttttattcccagtggatggactccaggtcctaactctctgacagcagaaggtggtacagacatttttactagagttgaaatccaaatgactaaagggcctctggaaataggaggccaactccacaggaggctaaacactttaaggtacctgaaacttggcgcattagtgaccaacacactagcagccttttgctcccttatgtcatcaaatggctacagttaaaacattctaacttgtcagcctacattaagaggtagttttgtacctctgcaggaaagctgttcttttatatactcaattcttcttaataaaatgttttaaaagcacttatggccagtgctttatgtggatgttggaaaaggaagcaagagtttggactaaacctgaaaaatccacatgaactttcttcctttttttctaattgcctacgtctgctctctcacctccaaggagtgtttgtctgtgcctcttgtctctctttctgtctcacacaacacacacacacacacacacacacacacacacacacacacactttcttcttgctgttacatcatcatttcaccagaactctcctaggaaggagaaaaatggttcaagaaagagaaaaatttgtcaagcactctcttgggaagttaagcatgttacccactgggaatagttatctcttccattcatacagccccttacattttataatgctaccgagcatctgttgttgcatgctgtcatacctagtagagccttgtgaaatagatcatggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttttttttttttttttttttttttttggagacagggtctctctctgtcgcccaggctggagtgcagtggtatgatcttggctcactgcaatctccacctcccggattcaagcaattctcctgccttagcctcctgagtagctgggattacaggcgcccaccaccacgcccggctaatttttttattttttcatagagacggggtttaaccatgttggccaggctggtctcaaactcctgacctcaggttatccactgccttggcctcccaaagtgcttggattacaggcatgagccatcacacccagcccatgttaaattttctacgtgaagatcctaaaagcccccaactactcagatttaaaatcaggtataattatagccttttcccagaaaattttaattgataaccacctgactcatgctttccagtatcacagaacctgaaatgctaaacttctactgatgaaaaaccataagcccttgtattttcttgagcatttgaggccttaaaaagcaaaaaaaaaaggttaaaaatatttataacaactgacattgacattaacatttgctcagtgctttaacttttatgaagcacttttcttttatcatattaccctctaattaatgatcctagaaaatagttacagttatttttgccttcatttccagtggcaagaaactgaatcttagaaagtgtcagcttgcttagttccatagagtatgagtgtcagagctaatacttgaccctgggcctctgattcccaaggccggctatctctacatctaacagaaaacactggaaatcccatttgctgttgctaggttacctttttcccatgatggtaattcttttttaaaatcctaagtttttcattaatgtacgcccattagagaaaaattagcaaatagaagaagaaaggtatgtaattctctcatctcagtataatagttcacattttgtcatgcacttcttttctgttatgtttacctgtgggtatggaaggatgtatacaaatgtaaccacacatctgtatacatgtggttacatacacacacacacaatgagatcataccttaactattggttagtaccttgcttttgttacataacagtatatcaaactttgccttctatacagtccgttttaaatattcttgaaccactgaaaaagaatatatgtcacctacatatgctttctgaaggttgattcaaggatattttccaaaaggcaaataaagtaatcaaaataatatgcacaagagatgcatagcaaataaaatggtgaaaagcaatgaagtaataaaactactggtaaaaaaataaaggggcaaagatgtagtagtaaactcagaccaaaataagataatattaattacctactaactacaatattcatagaagaaaagtaccattcagtacaaaggtatcaagcagtctgaagaacattactttttgataaatgtcacagttccccatgaagaatagccctgagctttccttcattaaatatcattatattgaaatgtataatttaaaaatactgaagtaagagataagaagggtgaaaacatattctttataaaaccttaacacattgcttttagtctttgataaatcataaaaaggagttaaataatatgattgataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactgcatagcaatgagaacgggatggagccgacatagtatgccaagtaatactagtctcattaattgcaacaggaaacagtgcatatgtattaacttaaaaaactagaacagacaagaaaatcaaccttaaagaaatccattaaaataaaacattgttgataagttgaaaaatactgcaatgtttagatctggggatgattttttgaaaagagcagtgaaataaacatttggttaagataaccaagaaagaaacaaaaactacagaaaattaggaatgaaaaagacactcagcatagatacagatgacattttaaaattattgcacttaaaattttatatgagagactatgttctatgcaaatctaaagtacaggtgaaagaaacttgaataaactcgtaaagacagatggaatgtgaagctactacttgcaaaagagccagaaaatttcactaatcaaagttttcagatctccaaagaacaaatgatttctgtgctatttcaactttaagagcctagcaaaaaacgagatgcttaccaaatcattttataaagctagcgtgctcccaataataatacctaacctaggttacccccagaagacaattctgtgataatctaactttcataaatgcagaaatcctaagtgaaatattagcaaattgaataccacataataaaacattccagttattccatattcagtgctagaacaattaggaatcttttagcataatttgctatattgatatatcaaaattttagaaaaactagtaatctccatagatgcttttcattaaaagggcatttaataaaatttttcatgcattcatatttaaaaacaaaaacaatggcaatgcaaaataagctctaagtagtatttacatatttcgatttattatgcaacatttctaacatatataaagatatgaagcataatgacaaaggtccatgtacctgttatccaatttaagaaataaaacattaaaaattcagtagaaatcccttgggttctattccatgatcatgttcccccagagagagccactattctaaatttgttttttatcattttatgcatttctttaaacaatatgtagtgttgttagcacatagtgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaattttaggtttagaatatataacagaaaagtgtcctcatacagaagcaataaaaaatataaaatatctaggtaaaactttaaaacgtataaatgatctaagtgaggaatgctaaaaaagttttgcatgaataattaactcatgagcaaaaagggtattttggggattgaatgtgctttggaaagcctctctcactttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccctttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgagattagtaagattttggttggagagtgtagaaataggacagcgtttgctttcaccctaaccagaatgaagggtctcagatttccaggttaaatgcctctgaaactttattctagaaccttcccactgccctagtttgtttaagtcaagcatgaactcaccactcaatgtttgccagagtttggatgaatgtcagcatcaggctactgtaataatggtttaagattatttaatcccattagttatacacttcattaggctgagtgaattgttggcagtggttcagtaaacttcctcctttagagataaaaggacagaaagaaaataggaaaggagcctattcctcattttctttcatagttataattcttttttttttttttttttttttttttccgagacggggtcttgctctgtcacccaggctggagtgcagtggtgcaatctcggctcaccgcaagctccacctgccgggttcacgccattctcctgcctcagcctcccgagtagttgggactacaagcacccgccaccacgcccagctatttttttttttttttttttttgtatttttagtagagatgggtttcaccgtgttagccaggatggtcttgatctcctgacctcatgatccgcctgccttggcctcccaaagtgctgggattacaggggtgagccactgcactggccataattcttaatggataaaggaatgataattacccagctgtagcgtggactccatattagtacggtctcctaaactactcttcattctcaggagaaataaatgtttgtaacctaatattctctattagaagaaaatggacagtggcagagaagagagtgtgtgtccgtgtgatcaggccataaagttaatcttaaaagtaaacctgaaaataaattcaaagattctagatatgagagtcttttacgtagtggggttggtatgaggcagtaaatgattttaaggaaagaatatagaatttaaagtgagacctggttcacactcagccagctgctattctgcattcttccctttacttttagcttcagtttcctcacacttagaatgaaaacaaacaataagagcaaaccagtttgttatatgttctcacatctgactttgtaaaacagtttgaaaacattagcgtgctcagctccaggattgtcccatgcaggcaatgactgttacatctttcccttctttgtagtttatttttgcccagatggatctgcattcatttgtactatctattataatattgttagaattcactattatactgtagaattcattaattctattatattgtagaattcactaattctataatattgtacaattcacattatatattataacattgtagaattcaccaataatattgtaaaagtcactaataattcataaaaggaatgaattcatttgtgatcttatcaaaaaaaatttaaaaagaaaaaagaggccgggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaaaagaaagaaagaaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttatctcccatcagctctcctacacattctttttacaacacttgcccaaggtgaggactcttctcctggacattgatatggaggtttctctgtctattcccatgccattggttgcctaccttctgccttttccgatctccagccttaaaatgctttcctggaacttaaccaactagatgtaaccatttctgaacatgcaaggttttcatttccacatctctcataggattgatcctcaccacaactggtattatcaagtcactggcatccttgacacactccagtactgacaggaaccccttgaagactgtgcggggtgcggggaggtcacccttttttcttttcttttcttttcttttttttgagacagagtctcactctgtagcccaggctggagtgcagtggcgccatcttggctcactgcaacctctgcctcctgggttcgcgccattctcctgcctcggcctcccgagtagctgggactacaggtgcccgccaccaagcccagctaatttttgtatttttagtagagacggggtttcaccgtgttagccaggatgatctcgatctcctgactgcagggaggtcacctttaattcgtctttgtcttttctgtagtgcttatcataataggtgaacctattgctgctctgatagtgagggggatttggggggagcctgtgtcactctagcactatgtctccccacagtcattgactcacataccctttgcttgccccttcgtgcacctaggacctgagactatgtatgtataagaaggaaggaggagaacttggctctgagagactatgaacagagtcattgctgaaatgtaaatatcaaagattgaagggaaagatgtgagagtgaagccagctgtctagcttccagccgtagaatgatcataagagctactacactcaaggtcaaacacactgactcacccatgaaaattgccaaggagtttgagtggaagttctctgatattccaatgactttgaatgggacacggtaattccttcccacagccagggcttacttaaaataagtaaatgaataaataaagtctactccctggatcttttttttgctcttgtccctgcagagtaaggggatgccagccaaggctgacatcatcattatagcaagacaggtgctttttttgaatacttcacaaggacaagggcctggtattatgtaggtcttcaaagaatatatatatatataaatttttttaattcagtctcctacatttatagtatggggaaataagacaagagcgaggaatgccttgcttgggatattgcaattggatggctgcactgaggactatttaagcaaccttaaaatcacaaacacacatctgtgatgactttttaattatatctgtcattttggaaaagatattaaacatcttcctcagaagttatttttactttacacactctttaataatgttaaaagatatttgatgcaatttatattaataaagctcatgggacgtgttagtaaaaataaaattgaatcttctaaaatatattcctttaaaaatgaatgtctataattttatgctagtttaagcaaataatctgaataaatcctgtttgtttagcataacacatgtacacgtagtttctccacaaaatggaacgcgctaaatgtgttggggcctcaggaaagaactagtggaagggggcataggaggatttgggggcaaaaggaggaatccaaaaagaaggtcttcatggaggaagagacctgtcccaatgtgtcattcggtagatctcactttctcctagtacctcatagtcattcatttttcacccccaacagacaagtggagactgatattattcccttttacaatgtaacaaaatcaaagcttagaaaaccagggggtttggaaaataaggaatttgtgtaggattaaaatagaactttgagctcctggactctgaatcttagcttctaccttgcacttaaataaatttatgctaacagatgtcctgtcatcagataggacttttttttttctttttaatgtcggcaagtctcattgttacagctctctggtctgcccagtttggttacacctgttttgagattccttgcctatacccttccaactgaagacaagcacttcctactgtacttacagaactttcatctatgtcttggtttaatcttttgcctttgttttaaccgtttaccacttctgctttatattggtaggtaatcttacccccaaatacatagactatgagctccttaggagcaaactcattttttttttcctgttgttctttgtgtctttttttccctatccacctccaaatcttactccacatttctgaaaatagcacccaaagcaatacctctcactttggggagtatttagtacattttttaaaaaatgaatgtattatacagtctggatcaccataacaaaaatacaaggactgagtgccttaaataacagagatttattttcttatagattgagaatggaagtccgagatcagggtgttagcactgtaggattctgctgaggactgtcttcctgacttgtagatagccaccctctcactgtgtccttacatggtgtgtgtggggagggagcaagcccactaagtgtcttttcttataaggtcactagtaccatcatgagggctccatccttatgacctcatctaggcttaatcacttctcaaaggccccatatacacatactatcactttggggttaaggcttcaacatataaatttataaagggactcaatttagtccatagcaataaattaggccttttgactatagatctgtaagtgcataattggcactgattgatggattgcagatcagaatatcctatgcttctagttatatagaaactacatgcttagtgttttttttttttttttagacagagtctcactctgttgcccaggctgaagtgtagtggcacaatcttggctcactgcagcctccacctcccagattcaagcgattctcctgcctcagccttctcagtagctgggactgcaggcatgtgccaccacgcccagctaatttttgtatttttagtacagacggggtttcaccatgttggcccggatggtctggatctcctgacctcgtgatccacctgcttcagcctcccaaggtgctgggattacaggtgtgagccaccacacccggcccatgcttagttatttaacagaggtttattgagcactgtgttggctttaaacaattttgctagacattcagtagggcctgatgagtgtttaagacctcgtacagttcaggtgcattttcctttaaggatacatttaacctgctagatgtcatctcattttgaagacaagagaaaaagagaggaagacttgttttttcagagggttattatacattcctattagatcattaggaaattggcacaagtggcaggaagccaaactgacctgagtctggctgggcagtgtctgcaggttactccagcaaagctgctggaataacgatgtgttcttccataaagtgctttttgtcaaagtctcttctggaattaactcctcatgcacagatcgataaaccccaccaacttgccaatgtaattaagaagtgacaggttaagcataaccattaattaagttcaaagtaaaagaaaatgaagaagattgtttttgtgaaattgtgctgtcagatttttctcaagggtatttctgagttcctataaaggggaatttaggaaagggaggagaagattgtctccacttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacagtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaagtatcaaatagtcttagactcattgtcttcctctgatggcatcttaatggaattcaatacaaaggccaaaattcctttgttttgaagccacaagaaaacacagccaatggaaaagccgtgttagtgctgcctgtcctattctgataaggtgaatacttaaaagctatgaaagaagcactgagtactgctggacagtttgagttcatttggctggtagaattgagtggaagtcaattctcatgccatttaaactggaagaaactgaagattctccaacccaagctcctctttttgcagatagtcaactgaagccctgtaagactgtagttttatagataaaaaagagccatgtgaatttcctaaatcacataacagtcagtttattatttgacatttatggtacattcacatggaagagaatgattagacatttccaggagagaataacgactcccaattccctgagttaccattagatggtattaagcaacttcacttaattatgtacctgttttccagttatgttaattatacatcctttagcatttaccacctgtaccaatcatttagcataataataccttatacttaaatgcaagtacccagaatacttttatagttgttttcatttgatattcacaacaatcctacaaggcaagtgttatttctagattagatatgagagaactgaggcatagagaaggtaacccatatagccaagaaactaaaacagggttctgacatccattttctaactatgcatctaggtttttttttttttttacctctgcgtctaagttgcctgcctaaatcgccttcagtccattgaaatccatccaatcaatatttactgaacatcatctgtatttcaaatattgtagtgggcattgggggtatgaaattgcaaaagagagaatcatcagtatttgggaaactcactgtttgaatgagatagaaagccaaacagataaatgggaattattttaagtgccataatgggtctatgcactgtctttggagattggatggacagggtagcaaaagattgaggagctaattttgctgctgtttatctaagcatgtcagggtcctgtcttttcacgtagattatgagtgtcttggcatgtcttttgtctctctgcatcccccgaggctccttgcacagtcctcacactccactggcgttctgttaatatttgttgatgatgatactggtgattttttctctctgacatccagaacactggagagattttctgttggcccttgggtataacagatttttatttatacatttgaattagccttttagaaatcattcttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgttaacacatcaaaatagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaccctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgccactaaattatttttttgaaaaataatacagaaatttgtaagcagacacaacagctctagtttatccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgctgtcagcatggtatttcaaatgcttcacaatttgaatttaaactagtcaatgggatcattaagattattatgcatgttttccaaagagtttgaattcaaatgacaacttaaaagaaaaaaaaaaagatgtccttgaaaaactaaggaatgttagtgcacttatagaaattcttgcagtttggagtaatttgccacctccccttctgaaaaagtacctgatgatagtgtgcttgagagataggggtattgcagacatattccttaggtgagtaaaactgaattgtaaagtggatgctatggaccatggattatttcatttagtacgattgacagtagaaaatcaggaagggacgtgcatcagtgcgaggctgacacacagatctgaggatggcagaagctcactgaatagcacacgcaaggacccttcaaactcatcacatgtgccgtttggttccctttcaatgggtcggtcttggaatatggaggtctgctttcattttgtgccaagtaaccacgtgagcagtttacaaaagatacaaacagaaggctgctcattcatttttcaaaaagacttttttttttttgcaatggagtttgcaaagtgattttgcaatggattttgcaaaaaaaatggatgccattttttttaaataagtgtaattccaatgatgggaaatttactagctctcaaggcagcttttccttgtgttgaaatctctaaaggttaaaaagttactttttggaaagaagtctatttccttacaacatgttttcattggtccatagagaagacagctaatacatcttccacttggcagccttttaagtatttgaagaaaattctcaagtccatctgaatcttctgttttggctaacttctagttccttcatccatttccaacctaaatttgagcctaacgaacagatttcttctttcttatttaaatatatatatatatgaggaaataaaggcacagagggcttaagggagttgcccaagaacatagagctggttggatgactggaatgtaaggctgtgtggctctaaaccttgtcatttagactagaacacctatacgtcagttagcttcctgccacttcttgttttctgcctggataggactttataaagagtttggaagaagggagagttccgacgaggtacagaaatcagaacttccccttcttccaaactatatacaaataatcagttaatcagattaaaggactcttagtaacattgaaatcaaacctttgtgtttccaggagctctgagaacaacaatttttttggagcattgcaatctcttgagtatccaaaatgattctgtaatgatgtctgtgaggtcagaattggagcagcaaatggaattcctttaagggcttcccatcaatggacagctgattccagaaatggaggaggcacagtttgtatccaaattcataagcacaagtgggagaaattaggctttggtaaagagggtgacattcccaaaggaatcatctgtgaagttggggaaggaattcaagctcagggctgctgttctctaccaggttcttcagccagctggacatgctccccaggtttctactcagtctggaatgttagtaaaagtccacttcctctccttgtttctcccttctagtgaaaacgttcctcttctctaccttcctgacctcaagaccattgttccacacatcccccctcaggatcccaccccgccattctcattctcattacattgtttctggatccatgtctttatcagatgcagcccactgtccctttcagaagatgccagaaaatttacatatgtgatcaaatgttcccatcacaacagttctttccagtaatcccagtgctgggcagctgattccagtaatggaggagacactttcagctattaggcaatggatcacactttcaaaggagattgagcaatctcctcatcaagttgtacttagagcacaaatctggtgccaaaaggcactaccggattcagactgacagcactgagagttttgagtgaaagggaagttagactggtgttatgtgtattcactgggaggaactcaccgggagaaataaagagggtttccagtttattcattgtgtaaagcggctataatagtatttataggggttttgtgaatgtcaaataaaattatatttggaacagtggctagtgccataagtaggacttaacctttagcaatatgtactacattaaaaggaaggtggacacatgagtgatctctagcattttgtgactggaaggaaagagactggatgaccactcttcagagatgctatggacagtacttttgtcaaggactgggagtggagaaaatgacttatagtggtctttccaacatgaagtttgtattaatccgttttcacactgtgaggaagaaatacctgatactgggcaattataaagaaaagaggtttaattggctcacagttccacacggctggggaggcgtcaggaaacttacaatcatggtggaaggcacctcttcacagggtggcaggagagagaatgagagacaagcaaaaaaggaaaagccctttataaaactatcaccccctgcctcggtgcggtcgctcacacctgtaatcccagcactttgggaggccgaggtgggtggatcacgaggtcaggagatcgagatcatcctggctaacacggtgaaaccccatctctactaaaaaaaaaaaaatacaaaaaaattagccggacatggtggcgggtgcctgtagtcccagctactcaggaggctgaggcaggagaatcacttgaacccgggaggcggacgttgcagtgagctgagatcatgccactgcactccagcctgggcgacagagcaagactccgtctcaaaaaaaaaaaaaaaaaatctatcaccccccttgattcacttacctcccactgtgtcccttctacttcacgtggggattatgggaactacaattcaagatgagatttgggtggggacacagccaaaccatatcacacatgaaacacagaaaaaggacatctttttacatggatcttctgatatgcttgtaccaaagcccacagtatatcctgtcttcttgaaagagtatcatagttattcatttgccttggatggaaataatgttgtaataccagttaatacttttttcaactaaagggaatttggcttcatctccagttgcaaattcacatcaggaaatatcaaatccaaagatcaaaactcagtatctcatcactttcaggaccatccttgccacttgtctcaggcatcatgtacctggaagctgaaaagcaatgtacagaacctttgaattggagagatatcaatttgaacccagatcctgctacttcctacattgtgaaagggatcaagtttctttagttctctaaagcaaaggtttttcatctataaaaggaggttaataaaagggaatacttatcatgttgaattaatgggaatattaaatgagtttatgtggtttaattgcctagcacagtatctgcctcctaagatatgtttaataaatgctaactgtgactatagagatttaccctgaagatacctgtcatgtcatgccttctctgtcaaatagatcatgaatgcagttcctagcctctctctcctgttataccctcctagcaatattctgatgcagatgaacccagccacttgtcttttgcttgccagaacagctgaatgttgctgggaaaaaaaaaaacaaaacacagccgggcataatcatatcattataagttgtgaccagccttgacctgcgccttgaccccacccacagcctacattcttacaccctgctctcaactgtttcagacattctctactgtgacttctatctcccttccccactccttccttctcaagggatgccctggcctcattcttcatagtgaaaatgaaagctgccagaagaaactctttcagcttctgctctcaaatctgtgcccatcctttctgtcccttagtgcctatcagattatcagttgccaattggtctccatgtatctctggtccctttttcccctgtcttctgagtgccctggctccatggatcatccattctttatcctacccaatgggattcttctcgtcaacatccatttgtgccccagcttggcccatattttccctccattgactccacagctctctgtagctattgctttatcccttccttcacagccaaactctggaaagttggatattagaaatgctgtctccacactattcacaatagcaaagacatggaatcaacttaaatgcccatcagcgacagactggataaagaaaatgtggtacatataccccacagaatactaagcagccataaaaaagaatgagatcatgtattttgcaggaacatggatggagctagaggccattatccttagcaaagtaatgcaggaatagaaaaactaatgctgcttgttctcatttataagtgagagctgaatgatgagaacacgtggacacaaataaggaaacaacaagcactgggatctacttgagggtggagggggagaggagggagaggaatgaagatagctgttgggtactgggcttcatacctgagtggtgaaataatctgtacaacaaacccccatgacatgagtttgcctatgtgactaaaccttcacatatacccctgaacctaaaataaaagttttttttaaaaaaagaaaaaaaaatcctgcctccatttttctatcaagtattctgcctgctaccaggcccctatcccttcatagactagctgaggacatcagggacttccatgttgccaaaaccgtgagtctaatcagtgtttacctaacttgatatctcattcttacaaaactgtccctcccaacttccttggcaccccagcctcccgattttgtttttaatttttcaataggttattgggggcacaggtggtgtttggttacatgagtaagttcttagtggtgatttgtgagattttcgtgcacccatcacccaagcagtatatactgcaccatatttgtaatcttttatccctcgtcccccttccacgcttccccccaaatccccaaagtccgtcgtatcattcttatgcttttgcgtcctcgtggcttagctcccacatatcagtgagaaaatatgatatttggttttccattcctgagttacttcacttagaataataatttccaatttcatccaggtcactgtgaatgccattatttcattcatttttatggctgaatagtattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatattccatcatatatatatattccatcatatatatatattccatcatatatatatattccatcatatatatatattccatcatatatatattccatcatatatatatattccatcatatatatatattccatcatatatatatatttccatcatatatatattccatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattcatcatatatatatattccatcatatatatatatatatatattccatcatatatatatatacacacacacacacacacacacacacatacccacacatcccagtttctttatccacttgttgattgatgggcatttgggttggttccatgattttgcaattgcgaattgtgctgctataaacatgcttgtgcaagtatctttttcgtatgacttcttttcctctgggtagatacccagtagtgggattgctggattaaatggtggttctacttttagttcattaaggaatctccacattgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatattaaacatcagtgcaggctgggcccggtggctcatgcttgtaatcctagcactttgggaggctgaggcgggtggatcacttgaggtcaggagttcgaaaccagtgtggccaacatgctgaaaccctgtctctactaaaaatacaaaaaaaattacccgggcatggtggcgggtgcctataatcccaactacttgggaggctgaggcaggagcattgtttgaacctgggaggcagaggttgcagtgagccaagagcatgccactgcactccagcctgggcaacagcgtgagactccgtctcaaaaaaaaaaaaaaaaaaaaaaaaaaaaaccaaccatcagtgcagaagaggatgtggagtggagagactgcatcaattatattttgctgatgagaatataagatggaacaaccattctagagaaagttttgggaatttcttcttttaaaactaatcctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaaggctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgttgggggaaactggataaagggtacttagatctctacgttatttctttcaacttcatatgaatctacaattataagaaaatttaaagtttaatttatagaaaaggcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagcatttaaagatgttgactctatctttgtttcatttgacttctatagcaccgtacactctgggttttcttcctatcgctgtacacaactttctaccgtttttaatagatttcctctcttcattccttaaattctccatttttcttgagttctgccctaatctcccttcttgtctcaatctgtactcctgagttatttcatctgcttccgtgagtacaaatatcatctgtgtgctgagaactctctggccaaaatctgcagctggatctctctgtaagctccagatatgtatctatcattttagcctgcagtcttcatagattggcccataggcccacaaatgcaacagtttcagacagaacccaaggtgttcccttttaaacctgctcctctctgtgttccttttccatgaatggcattaccttgttgctccaaccaaaggcacaggagctggcctgtatccttcctcttccttcagtatcccctcttatccacttattaaccaatttctgacataatactttggcttcctttatatcttctttcatttatgagacaagttccttcagtgttttctagtgacttttcattacttggaagagacagttcatactcctcacactaccatgtaaagagctcatagccacatgcacacacatgcacatccacttgtgcacacatacctaaacacacacccaaaacagagagattgtctcatgcctgtggctgggtaaacacttgtccttgatggaatgtgtagctttcccatctccatcccaatcacctagccaaaaactctcctccttcaggcctccatttagacatcacttttccctcaagtatgtgtgattcttgtgccttatcctccccatcatcctgtaatagcatcctctgcttttcctcatcatagcatttagaagactgtatttaaattacctatttgacacatacctcagtagctatacattttccctaaggggagggttgatgtcttgtttctcattgcatcctgcagtaagcaccgagtaagtgtttcttgactctggggctgtactgagttgaagaaggatgacatcactgactacagaaccctttgtataagcatcaaaggggtagcagtggggtaaatgatcacatcctggctaaatggttccgattcctacaaccctgcagcacgcccccccggctctaaaccttttagtcatttcctgtgaatcttgccagcactcatttcattttttgttttttccattttcttcatctttcccacatagtatagaccagaatgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaaccctttttgttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtctctagttgttctgtatataaaagctaaacttcttcacatgtttctgtttctcttgtttatgcgatcgtttgtcattggccttgtgttggtgatgtatgttctgaatgaataggctccagcaattaagtgactgagatgaaatgcttttgtatctctctagcctcatttcttttttttttttaccactgtgatgcaaacacatggaactactgttctccattgcaccatgattagtctatccgtagtcttttgtgtgtgatctttctgtacctagaacactcgtcttgggcttttgcctggccagtacattgccatccttcaggtctcagctgatttttcacttcttccatggagccccctctgacttcacaagattgcgttgtcctgctcatatgtcctgctcagagcatgctgcatgtctcacttcatagcacctgttatttttttagtatagattttggttttgtttgcctgcaccccattccttgaggacagggaaagtttctgtccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacaacttaacgcccttcaagattttgtgtaacagggaaaggagagaacacctggaatggttcccgcttggagaaacgtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagcttctctgatgcagtgcagttcagtgcaaaccaacggaaagcccacagtttttttgtttttttggttttttttctaggtgtaaacaaacctggttgattgtgaggcaaagaaaaataacaaaaacaagtgagaatacattagattaatttactctttcttttttcccgctcattcataatgtgattgaaatcagaagtaaagaaagtaaaatcagagtgagttccctctgctcagtcacccaccctgatcacaagacttttggaatactgggaggcactgcatttaagtaagtatcagctgtatggagagtatgaggttaagatgatgctggatttaatttaaagtctcctcactggtttgcgtgaaggaagatttttatcaagcagagtgaaagagacagaatcttgaagcttccgcagaggggaagaagacagggccgtgcactgcgagtcagtatgcctccagtccctctggtgggcaccggtccacatcacaggaagcccagctgtggtggctgtcagtgtcagaggggctggcagacagtagtagaggcccagagaagttactttgtacgtatcagtctagaaggaagagattatgaagattagtcaagcctccctttctcatttatccttttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatgttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgggcaacttttctagccttccgtctaattgggtttaatatcagtgaaagaatctttaagaaggtgtgcccttaggtgctagggccagtattgtaggtggcaaccaggtacattagtctctgcccttgtggaactcatattcccatgtttgtaaaggagtctgggcctcttatatgtggtaaatgaagtgactgtctatgtagttgcctttgcaggacacaagtccttgccttagtttccctccagccaggactgccccaccgagactattcatagctccaacttaaggtgctttaataaagggcagaaatcatgacaagaaaggacgcttttcttcaggcaatgaattcagcctgattttagaagctgttttggagaggtctctgtaagcatattacattttattccctgcagtacaatatttatacatggataatttgtattgacagttgatagttacatagaggtatatctcactggttctcaactctagctgcattttagaatcaccaggagaattttctttttcgattctgatgcctaaatctctgccctagaacaataaaatcagaatctctaaaagtgaggcccagacatgggcagttttgttattatttatcattgtttaataataaatattacgtaaaagtcagacttttaatggctcatttgtagggaggagaacttgccatttcccaaagtatcaccagcataaaaggtgaatttgtattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcgaggagatttgagattcagcacaaaaaagaattcgatatcacctaatacaagctgagaagggctacctcagggggtccttgtgcacctcactaaggaaggtctttggcagaggcagagaccatgacaaaggttttttttttctttattggacaagagccagaaaaaaatggccccaagattatgctcagccccgggaacctacagaaaccatggagcagtaggaatgggtagctagccgtgttagaagtaaatttgaggccgggtgcggaggctcatgcctgtaatcccagcactttgggatgccaaggcaggaggatcacgaggtcaggagatcaagaccaacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcatgccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacacgtgattttcttaatgtcttagtttgagcaagtaattctaactactctagcaaacacatttttaaatctcagggatttaacacaatgcaagtttatttttgtctgacaaaaatcccccatgtttagccagtgcattccacgtgggattcagagactctgtcttattccatccagtggttccaccagtctctaaagcctagaggtcctatgccagattatgtgaattaaaattagaagagagtattaaggatcttctgggacagtggtgggatggttacagtttccagactcataaatgtaaaacagtgttccttctacaaatattctattggctggggctcattcactttcacacagtaacaaagaatgcttggaaatgtggccacactgtatacccccaaaagaagaggaattagtttggttcaaatttatctagtctctgtcatgctttcatcatcatcatcatcatcgtcatcatcatcgtcatcagctactgtggatcagcatactttcctgcaattttccaaatcgaattttgtggttatatattaacagagtatataaaattcattttccctacataatatgtattttattcctatatgtgttttctgcagtggtctgatttatatcaatgactaacatatagattcgatttgcaccaactagataatttaatctcttactcctccttgttgacagttggtggggtgcgccttatttttgaagaagaaaatgcttatccagttattcagccaatctcagttgacagcctatcacatgtcaggcactggaaattccgtggtgagcaaaaacagacaagtggcctgctttcaggaagtttctattctgttaagggagatggacagagtgttttaaaagaaaggagtattgtcctaagataattaaaacacaggaacctgacttagacagagattaagacaggcattcctaaggaagtgatacttcactgagttatgaggagtgagtaggagtttagacatctccagacagtgcagcacgctgatttgaggaactgaaagaaggccagtgtggtcagagctcagagactgagggagaagcatgatgcaggatgagttttgagagataaaccatgaaggacttaggccttgctaagcattttggcctttttcccaaaagtacaggaaagcctagccattttattattttataccacccatccattacaggcttttcctgaaaggtctttggcaataggggagctatggaagcaacatcatgagtaagtgactgggggaaccttttccctaagtgttgtggttgctagccacacaccatgtattcaacatctctccaactctcctcatcgtttcccagagctgaaagtaagatgagcacgaagaaaccatgtttagttaagaacatgacccgaagagtgaaaggtatttcctgttccaaataggagcccagtctgcattttctactacatgatttagtagaaagacacattggatttgaaccatatttcttctgctagccaattccatcttatctacaactttttgataattattttgagaaatagatctagatcacagccttccaattcctaggccaggatactttccatttttctacacagaccccattgcagtcctcccttcttcacaatcttcaaaatatccttctgattgaaccagatatcttattcttcatcccgtttcctgccccctaaaatgacctatctttcccttctaaaacttccactaactttaaaattggagctcaaggcttccatctccacagactctgccctgacaacaaattggttggttttattttcttcccaatgaatagaatagccgttagagggaattgtcttcagctcttttcccctcctcctcctcctcctcctcctcttcctcttcctccttcttgcaaatacaaacacagcagggctctatgcagctggttactctaggctctggtaacctaacatagcaggggaggacagaagtcaatagcgtgagaagtctgtttttgtcacggatttgctagaagctattaaagtgttcttcctaagtctgttacttcataggttgagggaagtaatgcatcccacacaagaggactgggatatgtttaaagtagtaggaaggcatttgccactattctagtccatcctgcccatgctgcctaatgtttgttcctacagatcaaaatctcataatcttctagacttctagatacagaagagttggagagatcaaagccttgcctctgacccagattattcgatctcatctggcatatcctacactctagccatcctgacctgccgtgtgttcccctaaagctcccatccttttctgactttgcttttcctcattctgtcccctgcattgaaatgcctttcccacatctctatgtctaaatcttacatggccaattccaacgtaatctaatctctgaagattccctttgctccccagttagaagtagtcactccctgctctgctcactttttgacatatattaatttatatagctatgcatttatatgtgtatgtattatattccttacaagagaagcttttgagagaagggcctataacttttctttctatttgtgtttcccaaagctccttctggtgggaaaaatgctttgaggttgaattaagctcacattgaactctatgatgaaaccatttgcttatgaacttggacaagtttctttacaactctgaaccttctgaattttccaccaggagaatgggaatgaataagtaagaaaacttataagacagctcctggtgtagggcctgactcatgtcaggttcccaggaaggccactttatatccttcatacatttgtatgtctgtgttgacattgaatgtttgcatgacatataaaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacataatagacaatgccactcataaatctagcccactctaggaacataataaggcctgttgagacattcagagatgtctccctgatcttcaaagatgaatttttattcttccctaagctgctgtctcttcagtctcaacatcctaagttcattttatctttcctcacaggtcaggttttcagctctaactgtgttcatcctggtggctctgccctggacatactgcagttcttttatgtacctcttatcgtatggggtacaatggctttcggtactgctcagtgaggggagagaaatagatagtgtagtttctgatgtcaaggaacactttagagagaccttaattaatgtagccatatgttgacttcctggagcactcataacaacatgggaagcccacgctgggaagatgctgagtaggaataagagaacaatgctaagagaagggaaatttcaccgtctgtgaagcgtctgtttagattttatgtttaaactttatgaactctgtcacttgctggtgaattttcttgctcagtatcttaaaatacagctgcagtgtgggttccaccctcttcacttaaaagggtgattaactgtttgtgatgaataattatttaattgccagttcagctacatgtgtgtagttgttttgcttctttcctcttcagtgtgagccaaatcttctcaataataaaaataatccagaattagtcaactgccttttatcatgttctcattcagcctgctggagcaagaacattccaattctacatcacctttagcttaaaaagtaaataaatagaagctctcactcagccagttgatagttttactctcacagcctctcctgtaactaataaagtcttgacttcatcttgaaccttttactctatctttggataaaaatttaatcagaaagaattattgctcttttaatacctgtttaacctttacattcgcgatgggtacaaaaccacttaagatttaaagctctcttgttatggacttgtatgctgacctacttttcctcagagatattttttgcaagaattgttgaagcttgacatggggatcactgcaaatgtctcagctttgccattcactgctttccattcctatgtcctccttgccctgttaattattttaacagagacttgctattttaaggaagctctttatcgttactaaatctttttttattgttaaactcctttttctttccagcatagaagtatgtcatgttttctgtcttcagaatgtgcaagtgcttaccttctcataaagtgtgcctgttaccttaattttatagtctttatcacaaaaaggtacgtaagtggggttcagaatagtgtcttgcacttaaggtttaacttaggttttagtttcttcatgcaagcaacttgcatatgtagagaggcagcatgctatatagtgcaatgttcttcttggtttttaattataaaagtgatttcttttctagtaaaaaatcaagttatgcacaaatatatagagtgaaagtgttttcaactcctctctctagaggaagccactagcagttggcatatttccttccagaatttgttgtgtattataaacctatatacgtgcgtatgtatacacacacagtagtacacacattgttctgcaccttgcttctttgttttccctaagaatgtatgcttgatatatttctaaaaataataatgtatatgggtctaagtatttttagtgatatagaattctataggatacatgaaccgtaactcccttagtcatttctctactgattagtatttaacattgtttcttttttttttttttttgccattaaaagcaaatatctttgtgcaattatcttcatgaaatgttgaagctttctttttttttttttttttgagatggagtctcgctctgtcgctcaggctggggtgcagtggcgcgatctcagctcactgcaagctccacctcccaggttcacgccattctcctgcctcagcctcccgagtagctgggactacaggtgtctgccaccacgcccggctaattttttgtatttttagtagaggtggggtttcatcgtgttagccaggatggtctccatctcctgacctcgtgatccgcccaccttggcctcccaaagtgctgggattacaggcgtgagccaccacacccggccaaaactttctgcaggatatatttttaaaatgggttttccaagtcaaaagtgtatgtatgtttccattttgatacctactgaaatagctctccaaaagtgaaaccaaatttattcttttcaatggtatgtaagaatgcctgattccccatactctcattaaccttgagcatgttccatcttttaaatttttgccaagaagattgtctaaaaatggaatctcattgtttgtatttgcatttttatgatttttggtggatttagcatcattttctatgcttagtaactgcttgcctattcatatcctttatccaggttttttgttttgttttgtttctttttggtttggttattcatgttttccttattagtgtattggtagttatatgagttttaaccctttgtcagtggctaatttggaactcctccacagatccctgggggtttcttagagcagctgactggctggcagagctctccatggccttacctccccttcctcttctccgaactcacacacacactgatcgaacagaatagaccaattattacctgcatttcatgttgggctttgtgcttgagattaaacaaaggttcccggggctaaacgtctaaaaaacattgccatggaatgaagagccctagattttgtcataaagtcatctgtcctaggctctacaatgtagcattttcaaattggaagagccttcagagattattttattaccaacacccatgtaatataaattatacagttaatatatgttgatatacatgcaatactgaagaaatctctaatgcattctatattctgtaacagtaatatgtattttattatttataatagcttcaacatatattgaaaactagaggcacatacgtctataaacagtgctcagggcgtattattttggtgtttatttatttattaggtatttattattttatttagtccatagatgatgcatttatctgagaactcctctgactcaaggcccagcaagaatctgctgcccacagttatgagtagctgaactgggccaagcttttaattctataaatagcgaatctatgtagacactcagctagttagtaccagagtggtacccagatccgtgatgtcttgactcttagtacagtgcacttttccccactttgccattctttgctggtgaccttgggtagatcttcttaactgctcagagcttcagttcttctctcttttaatgagagtaataatgcatgcattgatatcctgactaggatggagttggataaagactgttcttaccttttgtgaatagcatagtatcttacagaattgtgaggaattatccaagtagctattgcccctcatcatggtgttaaaagtaggattgctagtttgaacggtaactgcaggaattcaatgtgttttgattttagcatattcccgtatcatgtagaccagtgttaatatttttagtattttatcttagttcttttttttctgaaagtcttgatttttcccagttttattttttagatttgaaagaaaaagaaaaaggatgtaactatgactcttatgttttcaatctctctgaaatataacaaagtaataactctaaatggtcaacgtagtagtctgagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacatccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccaacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatttaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaattgttgaatgtaggtgtaaatctagggagaaattacatcttaacaataattatgtcttccagttcatgaatatacatgtctgtatttatttagattgttaatttctttaattattgttttatatttttcagcgtaggaatattgtacatatttcctaaggtttataatgaagtattccatgttttggggtgcttttacaaatggtgatttaaaaatatgcaatttcaagtattcattgctactgtatagataagattgatctttgtatattgcccatgtgtgctgtaactttgctaaaattatttattctagtagctttttttttattcggggggaggtttaatgaaaaaaattatgttttcaatgtagtgcatctttatatatatatatatatatatatatatatatatatatataaaatggaatacaattcagccataaaaaagaatggaatcatgtcttttgcagcaacatggatagaactaggggtcgttatcctaaatgaaataaattagaaatagaaagccaaatactgcatgtggtcacttataaattggagctaaacaatggaaacatatggacatacagaatgaaataaaggtgggaggatgatgagggttgaaaaaatacctattggatacagtccagtactcactcttcggtttatgggtgcactaaaagcccaaatttcaccactacacaatatatgcatgtgagaaatctgcacttgtacccccaaatatataaacattttaaaagatttaaattacattttctgtgagtagaaacagtttcatttcattatttgaagtcatgccttttctgtttcttgcccaattgccctggctagggactttcagttagttgttgaatggaagtggtgaacatgaacatttttgcgctgttcccaatattaagagaaaacattgagtcttttgccattaagtgtaatgttagaagtaaggttattgaacatgctctttattaagctgagcaagtttccttcttttcattagttttctgggaggtttaatcatgaaagtgtgttgaattttgtcaattgcctttagacataagttggtatgataataagacttttgttctacagctggttcatatggtaggtaacactggttaatttttaaatgttgtatcagccttgcattcccaagataaaccccacttggttgtgttgtactactccttttgtgtgttattggatttaatttgccagtagtttgttgaggatttttgcatttgtgtcatgaggtatactaaactgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgcttaagttgcattctacaaattttgatatattgtgttttcattttcattcaagatattttctaatgtatctagtaatttttttgacgcatggtttatttagaaatgtgttatttaatttttaaatatttggatattttttctaggcctttctgttattgtcttttagtttatttccttgtgatctgtgaacatgttttgtgtaacttaaattcatctaaatttgttgaggtttgttttatgtgctagaaatatggtatatcttggttaatgctctgcacatttcaaaaatatgtgtattctgctattattaggtgaagtgttctatagttgtcaattaggttaatttggctaacagtattgtacaagttctctctattcttactgattttctgtcttctttttcagtaaattattagagggatactgaaactttgagcataattgtaggtttgtctatttctcctttcacttgtatggtttttgttttaatgtattttgaagccatactgttaagtgcacatacattaggattgttatatcatcttaaccccatattcaattccttccttattacataatatgattctttaactctgaaaatattcttgttctgaattttagataatattaatttaactttcttttattagtttacaaagtatttttccagccttttgtttttagtctatcaatgtctatataattgaagtagcttgcttttagacagatacgtctttcattttatccaatttgaccatctgtattttaatttgtgtgtttacactatttacatttgatgtgattattgatatagttggattgaaattcacaatcagcttttgttacttttccatctgctatatttttctcttcctgcctttctttgaattaaatgtttttcacaattccatctcatttacactatttgtttattatttatactcttgattttaatgttagtattaccctttgatttgcaatatacacctttaattaactagagtttaccttcaaatactattatatcactgtctgagtagtttcaggaccttacaattgttactctcaatttacttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattggttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaagatagccaatatctcttcaatttttattttgttttggtggtttgttgccttcattcttttatattttctctttggagttctaactacatacaggcttaatatttttctataattctttgatgctctgttctcttacttttcactctttctataaatttctattgacctatctttaagtttactaattctttccccagttgagtctgcttatgagcctattcaaagtattcttcttctctgttactatgattttcatttctagcattttcattttattttcataagacagaatgagaaatattctcatatgacagtctctatatctttgagatcatgcaaattttcttcctttttcactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagtgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatatattgtttcttgactttttaataatcgccattctgactgtcatgagatggcatctcattgtgattttgatttgcatttatctaatgatcagtgtcattgagctttttttcatgtttgttgactacataaatgtcttcttttgagaagtgtctgttcatatcctttgcccactttttgataaagttgtttggttttttcttataaatttgttaagttcctctagattctggatgttagacgtttgtcagatggatagattgcaaaaattttctccctttctgtaggttgcctgttcactctgatgatagtttattttgctgtggagaagctctttagtttaattagatctcatttgtcaatgttagcttttgttgcagttgcttttggcattttcctcatgaaatctttgcccatgcctatgtcctgaatggtattgtgtaagttttcttctagggcttttatggttttgggttttatatttaagtatttaatccatcttgaattaatttttgtgtaagatgtgaggaaggggtccagtttcagttttctgcatatggctagccagttttcccagcaccatttattaaataaggaaccctttccccattgcttgtttttgtcaggtttgttgaagatcagatggttgtagatgtgtggtgtaaattctgaggtctctgctctgttccattggtctatcagtactcttattctgcctcaggtctttcgtgtgagcatctgctgagatctgaggaaaagagtataaattaaattccgcttctatctgcactgcccaaagattctgtgttttaatactaccctacaactagtctcttgcaactggttaataactgtagttttttttttctgttaccaatagtatggcattcagaggccttaaggcagtaaggcatctgccttagtgttctgcaagtgttcacatcctgtctctcctcagaggcatctatctttccttagatttcaggttacagtagtttccccaactcccacttatcagtagttttgccttctgcagtctcagttacccatggtcaaccacagtccaaaaataggtgactacattacaatagtcatgtagagactattgtctctctacaaagagagagaaagagagagagagagagagggagaccacatacatgtaacttttattacaggatattgctataattgttctacgttattattagttattgctattaatcttttttgtgtctaatttataaattatactttatcataagtatgtatgtataggaaaaaacagtatgtataggggttaggttgtatccacagtttcagtatctactggtggtcttggaaggtatcttccacggataaaaggacactacggtagttggttgttctgcagcctcagttctctatggattcaaaaccagttttagatttgcacactgtctggcttgttttaaattattgtatgggtgggagtggtgctcctttcattttctccatcttgtacagaagccataattattttcaattctatataatttttgattgaatgaaaaataccataatttttttgttctattagtagacatttgaattatttatggttaggttcatgacaacaaggaatgcttctatgagcacatgtcttttggtgtacatatataaaatatttctcaagggtatagatgtaggaatggaattcattaattgtaggagaatacatacgacacacacacatgtatgagttatagggtatatatatatgtgcatataatgatttcagtaaattattgatataaaaattttcaatgaagtataactcatagaaaagtgtacctatcttaagtggccataggatatcatttagactgtaacataagagaactatagatattcacatccccaagcattaactgagaacctgttatacagtgggcatttaggaaatgaaaagtgaaggaaaagttactgaccttaggggtcttgaaagcgagaaaatgattaagtgctgtatacacacacacacacacacacacacacacacacacgcacacacgctcaaagagtagggagagaaaaattatgattggggaaatcaataaaagcatattggagaagacatcatttgatattaacctttaagtatagcagtgtagatagtgcgtaagaattggattatagaacttagtcattatgttaggaaagaaacctatggccttgttttatagcaattactggggatatccaggtcttttgcactggaagaaataatcttagaaccatttattaaggacagacccttacagatcatggggtccaaaactgtcttggggtcgaaaactttctcatcttatagatgaggaaactgaggcttagggaagggaagggacttgcctggggtaaatttttgctagtaaatgtacttaatgagatctctcagttacactgaaacgtttgagtattggaacattgtgcttttgttgttttctttttctttaaatccttaaaaaagttgtggatacatagtagatgtatatatttatggggtacataagatgttttgatatagacatgcaatgcataataatcacatcacggagaatggggtatccatctcccttcaagcatttgtcctttgtgttgcagatcattagaatattgtcttcatcattcttttattccccaccaaagtttttgtaaggtagtaagaggatctttgtggaaagaattcttattcccttacgttcctcctggtctgttcctaggtcaaggttgagtacgtttatagatattctataaatatattttattttcaacattaagtgtagttcatatagttgatgatctaagcaataagaaataaagtaaaatctggataattttggttactctgcttttcctctgtgtgtttcaactacaaaattcctcactacaatgctccccaattccttttattggtgcttgcagtgccagtgggcaaactgaattcttcatgcaaccaaagaattccaaaaacgtatttcttgcagctagcataaatctccagttccacaatggtagcagtggtggattttacccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaaggactaaccctagaatgacatttttccctcattcctgggtaatttttgagatttcccctcatgcccaggagctaattatactctctcactctccctctctctctctctctctctcgctgcagctttctgtatgtgtgtgtgtgtattatatctaagaaattttactccaaacatctaacattctgggtacgggtttgatttggggaaaaaattacacttttttttttatcctttagcttttctccttaaaaagtatcagtgagggcagggaaagggaaggagaatggacccaaactaataaaaggattgatcagtgattatgaacaaaatatagcttctgtatttccactcactcagtatgaagtttgctattattttccccaattcctggagccagttattgcagcaaatttagcatttggagcttatagactcatgctagacagacacatatagaatttacgaatcgaattagaaaaatggtctttgaataatataaattgtactccatgtatatttttatatatgaatgaacctactggactccagtgagattagcaaataccttagctatttcattgcaataaaaaccatttttcagtcactcatgtccctctgggttcttcagtgatattatttgatgtatgctttattctgtgccatttattgtactgagtattttgcatgaatgatcttatgtaatcatcagtaatctgttaaatcagtatcattattattcttgtttcattgatattgaaatataaaagtaggttatcataaattaaaaggctacgggtagtgataaaattttattccaggtagtatctccagaatatgaattcttaatcactactcgtgtttattcattccacatgtcactgaatgcctactatgtctagcaaagttctagattctcttgtagttgcattactcagttattggctagataaccctaaacactgcagaaagctgcactctgcccccttgggattgcctggctccataagattattaccgttgctgagtttggggacccacttgagcaaatctagcatacttaaaaggaagtttttattctggagaagttttgttaacaaaacatctattggctgggcagagtggctcataactgtaatctcagcacttcgggatgccaaagtgggcaaatcacctgaggtcagaagtttgagaccagcctggccaacatggtgaaaccctgtctctactaaaaacacaaaaaaattaggtaggtatggtggtgcacgcctgtaatcccagctattcaggaggctgaggcaggacaatcacttgaaccggggagacagaggttgcagtgagccgagattgtgccactgccctccagcctgggcaacaaagtgagactctatctcaaaacacaaacatacacacatacatacagacccacacacacatacagacacacacacacacgtctatttagcatctgtcccaggcagtgcttctcaatagcatgttaatagatgctaaaggacctttagttaggaggtcaactggtctacctctgtcacttagtagacaagaaggttgccctaaaatatacactaagacagtatgcattacaaaaaagccacaataaggacatagcttaggagaaatgttatgatctctcttcaccagtctccttatatgacactggttcaattcagaagtagaggtgaagatagttaatatcctaggaataaatgttaaatctcccttcccctttcctcacagtattatagtcaattctcataaggaaatggccctaagttacaacattaagcttttctattcacttctaataactgaaattccgcccaactgcctcctcacttgaattccatgtactttttttccaaataaattaaatgactttctctaagtcaaatgctattaaaattcttgttgttcctcaaactctgctttcttgtagtatcaggtttattgtgacttgaatgagacttatttgtaaatggatgtattttccattccatcttgctcttgcatacacacacatacactgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataattagactttctggattttagatctattctcaagtatatattgtatagagaaccaagatgttcaaggactgtagagccagttataggtttggttttaaagcacttcatcttagactcatttcctttctggctgatgttagttaaaataatataagcctgggcttaagattgtatctctgagtgagacaaaataatagatgattctatctccctttagaaaaaaaagaaaaaaaaaaagcagcagcagcagtaattgactcttacgcttaggcaagaactccacaatggatttgttggggaaaaaaaaaatgttttcctgcttgtatgtgttggtttagattttctgttgtatgtgtgttgtgaaagaagactttggataattattgcgattttccaagcagctggtcttccaatggcattgttacagggtcagtctattttcctttaatctgaccataatgtcatagaacactggctgtttctttggcaactgttcagggaagactagctgttttctctacctcaagccaatggtggactgcaggcaggttctcctgcaagccacagggaagcagttttcattactggggtctttgtatcaacaaatcacttatttcactgtgattctgttgagacaggatccgaaagtaaatttcataagaaaaaaatgattatacatcaagctcaggtgactttaaaatttttcctttacattgagtaaagtttctggccacttttgaccttttttttcaaatgacattattgatatgaaatcagaaactataactgataaactacaaactgctgtatagacacttttctacacaatggtcattgcttttattctttatctaagcctgaattgtaaggcttccttctctttttttttttttttttttttgagatggagtctcgctctgtcgcccaggctggagtgcggtggcacgatcttggctcactccaagctccacctcccgggttcacaccattctcatgcctcagcctcccgagtagctgggactacaggcgcccaccaccatgcccggctaattttttatatttttagtagagacggagtttcaccatgttagccaggatggtcttgatctcctgacctggtgatccacctgccttggcctcccaaagtgctgggattacaggcgtgagccaccatgcccggcctgaatgattccttctcatcttctgggaggtttttctgacttgctttctcaattccactctcttaggcagagcttatacctcccttcatgtatgttacatgtacatgtattgagtcagtgcatcctcctaatgaaacttttcctgagatctctcttatttactttcttccttttctgaaattctctgctatttagattcagtgccaaagaaattgacatttttatttacttgctgaggaataaacagaactcgaaaggatttgggaacccaagaccaagttttatgaaataactaatcttgtcttcctaaatactataaaaatcttatataatccctaatacttagcatagtgctaagcaccgaataggaatacaagaaatattgcaatgatctgaattgcttacaaaatattgacaacaacttcttcattggtaaagaaaagctgcttttgacctttttttcttcctcaagagtaagtagtgagaagcataaagtacccaagagtttctttgcctttttgattgttgcatggaaacaagtatttgcaaataattaagatgggaaaatttggctccttgaaaaggcaggactgctttcagatatatttgaaatgaacttatacagaagccaacatggttatcagagcaattgggtctatttcctatcatctcttcatgatatcttgtaaaaatgccctgtgttgagagcactggtgatcatagcagtggggttggagtagaatctggtgcgtttcttcctctacagatctcctaatagcacttgccctgttttcacagagccttatcaaagtttgatgtagactccagtgtgtagtagtgggcagtgacctaccagatgacctctttgaacaagagctagtttgagccagtgtatagctctgaatcgatggaagatccattttcaaatttcaaaagggctgttaaaacacttagttctgtattatagagatacacaaatggatataacaaactggatgtctcttctgcagctgtttcaattcgtatgccatgttttctatccttcttgctcctggcaattttctttcctgaagcatatcacaccttcttacatttgacaagcattttcacagctactgccactccctgctgccaaacaaaacccagccctgtttgaattcttgagggctgagggatggagaggagacctgtttgactttgaaatggttttaacgtcactttgtatacagaacaaaaatggaaaaccagatcctgtgtttgtctaaaaactaaaatttcaaaacctaacctgaggtggagaaacagatactacagggcaaggaaatgtctgggctcaccgcaaaggaatgcagcaagggaaccacctgcagacacctgtttaagagtttacgtttttgttcttccacacgattattatcttagtatctcaactggctatacatgcttttaggaaagttgcagggatcatattctaaggcgtatcaaatatgttcagagtgcaagcatgagcagaatctctcctctctgctagtgaggtcctgtaggtctacaagttactaacttcaggcttacagaatgttagaagtaacgggtgcatatcctgtaatcaatcccggtattgagcaaacaggcacaaatgacacccagcaagaaaaatgacttgctcaagacaccacagcaagttcatggttttctgaactgaattccaagtttcataacttctaattaatcctcctttttttcccccagtacagctaatatgctttttgtgaataataacatataataggtgtaatctgtcagaactatttaatagttgatagtatgtatcctcagtttattgaggttcaagctcttctgagtattataatactttctattggtattttctctcttgagctattccctaccttgaatctttcagactagagatttcagaagattacgtagtgtctgtgacttcaactacacatggatagtccacaggactctggactttcacggttccatgtcagttggacaggtgttactctaaggccctgcaaaaatataaagtagtttgagaatcactctcctgttaatcttcagtaaaattctgagctatttatatgtgagattgagaggcagcttggtaggatggaaagagtttagactttgtagttctactgccccaggtttgtatcccagctttatttcctaacagtgtagccttgggcaaattgcttaacctctccgaggctcagtttcttcaaataaaaaaatggaataagccttcccttgcagagttgttaatattatatgaacgttatatatgtgaagtgcccaactccttgcaaatacctaatatacaccagcttccttcccaggcttttgctggtcagatctggtttccacttaactttggctgttggaagataagataatttattatgaagataattgtctggtaattgtcatgagaattcagttgatgataattgaatgatttgtttacctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggattttgaagacggagtatgatctttgacagatggtgttcggtgggaatgaggaaaaagaaaggtgagcttcagccagggattggaggtggaaaaaatgaacacatgggtggcgatgattcaggcagaggggcaggaatgtgaaggaactaagacataaaagtagaaagacagtttaggcctggtttatgagggggtctttgaatggcaaactcacctttggtggtccacgggaaggtttgttagaactgcaggagtgtgcccaaacctatatgtcaagccactaactgccagccatcagtttgaaaaccgaagcaattaagatcgctgtccatcttacctgaaagggaagctttgcactctaacttgaagtagcctagaaatttcagaaggttacatagtgtctgtgacttcagctacacatggataatccacaagactctggacttattttcactgttgtgtaatagggttagttttgtttttagcagattctcccaaggaagtgtggtaatcacatttctcaaaccattacattaactgctgttagcaataaattattgcttatgtgctaaaagtcaaaaaaagcttttcccctttggaacttctttactatactccctgatatgttttgctgtcctagaaactggtgtttgtgtgtgtgtgtttgtgtgtgtatgtgtgtgtgtgtgtgttcaattgagtcaagaacagaggagaggagactcaggctgaaaatgtcaagttattttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatcccaacttaatttcctaaatctgtcctatctacataccacaaagtgcttaactgagaaattaacttctgtgttacagataaatggaagttagattaaaaggataatacattttcatttttagtgttcttaaataatcctttttattgtaaataaatataacgttaactccgataagtccagactacttcactgagttcaccaccgaaatgttttcacaaaatcagcatcgttataccttggcttttataagaagttagtatacgaaacttgtataggaaaatgtctctgtattatctatgaaactgttaataaatatgttttccatcatgtccatgtcatcgtttacatatacgagatgatttcctcttagaattcattctaaacttctttaacagaaattatctttttttgattcatattctcccttttgtcctggttaccagacagcacaagtgaccatcatgtttagatttctgatacagttctctcttccattcctctctgtagcctctgatttttttttcagacttcagttggaaaaatcctaatgaatgtaacttttagttacaggttgaattcttttgaatgtgtatatttaaaataagtaatgcacatagttaaaaagaaacatgtttttaaaacagtggttctcaattatagctaaatatttagaattatctggatggttttaaaactctgatacccaggcagcatcctagatcactcaaatcagaatatctgggtttggtcacggacatcagtattttttttttaaagctgcccaatgtcattccaatgttaagattcattgttttagatattctttattatgatgttcatcatttttacagaaacacatttccaaaaggataaatttcaaaatcacctgtaaacccataatttattataagtcactcttaacacctaaaaatagctaacctgctaacctttttcttttgctttttccttcttcttttaaactaaaattacaataatatatgtgcatatatagtgaatgtattcatttatatattagacacaatttacatatttatgcttatatatatatggcatacatgtacacgttacaatatgtgtatttgttttattccaaatctgttttattctcagagacattttcccatatcttcccagatatattttctgagaacctggtttttaatgcttgtataacattaatacttgtagttagaccattttttttactcattcttctattcttacatattaatgttgcagacaacatccttaaacaacttttgtgtgactaatccaatttttttccttgggaataaattatgatctattgatttatttctatgtgggctgaattttgtccataagaatgaaaatggtagccccctaagatgctgtttgctccctgatatctcatttttctctagaatacgaaggaatggctgttttctgctcttcctaaagattcaggatgtaataatatactgtcacaggtttcagaagcatgggaccttggcaccgaaagggtctctactagctaagttgtcttggaaatgagtgggtccacttcctcttctgatacaggaagaacagggaggtcattaaatgatgacggggctctttgaagtgaaatgaagcaacattggagggtgtagcatgtaaaaactctcttctcggatacaaaaaaaattgagctacttgggctaggagaagtgagcctggatttggaggcttaaggtttcaggaaggtctgagacaaacttaagaagaaatgcatcaagagggttggaagggacagacgattgatgagagcactgaaattccagtgtgatttgggtcacccgtgtgacatggcatatatttatgggatacctggaaaataagggagaaacaagacatctatctctgtcacactttggggaagtatacgattaagttccacactctgtggtggaaagaatgtcctggaggcccccagtctttctcactgtgatgccatgctcatttgataacctcataaacacatttctgttcttattgccttacccattctgatgcactgatcattttttaggccatgtgaacagggcagagcttgtcattatgcctgggacatagtgggcattcagtaggtgtttgttgaatggaagaagcaggcacaatcacagctttcccttctggtgatctgctttatgatacaatttccaggaatgcattgtgtctaaaattggggaccatatgtacaggaaattctttcttatgtcagtgtgaaatccctccaaagtaaatccccctttatggttttttattggtgtttattcttttttaatacagaaaactgtaaactttttattagggcaggtttttttgtgcaaaagccttgtcatgggctagatgacatttcttttcctgtagagatacttggacattttataattcaattacttccttccaaaagccatatttagaattccagccaatctgtgagccagaaaggagtgagccagtataataatcaaggtaatgtggcaagaaggtgtgaaatttcttagcctttctagaagagatgggtgaaaataaatgttttcagggtcagtaaataactttcccctagtagccagacagaaagcatcttactttgctcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtgagagagtaatggaatgtgtatgtctctgctcttgaagataccaggggcacctcgaaaactcccctccccagcccagggtcaccacagccttaaccgactgcctcctttgcaaacctttaccatgggtacctagaaaaagacatacacacacacatttcagcttatggtttttgttcgtttgtttttgttttttgtttgtttgtttgttttgccagatacttaagatttaagggcaatcttaagggaaatctcttctcccatcttgactgaggcacagagatgtcctgttcccatgctgttgatgctgacagacgtaggacacgtttttttctccgtgtgccaccacactcaagcagaatgtataagatattttctgtctaccaaggatacctggtgacataatcatacctagcctttctttcctccctccgccccctcagcctctcaccctgccctcccatgggtctttatgtgtgctactctatgtagagtacaactcataccggatagcctgttacttattttggttcaggagcagctgcagaggatgaactggagaggacagtctacttgcaaacacttgtagactctccagtggacaggttacctctaaagaaagagaagcctacgctttcctactcactgaagttttttaccatttgcaagtggatccaatatatgtttgttttgggtgaggggctaacaaaatgctctgcggtttctgcaggtttccttataggagatcctgttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgatgataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatggattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacagggagtggaacagagagacagaaaatattgggagtcttgtgccccatcagtagaaggagatgaaggccagagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactgtgtcctaggcaccactttagttcttgagtggtcagcagtaaagaaaacagacaaaaaaataataccctggtggagtttccattctagtggggacacaataaacaaaataattggcaaattatatagaatattggaaggaagtacatgctgggagagaaataagctgggagggaaaagggagtgctgggggagaaggagctaagagtctcagttccagagttaggcagcctgagctggaattagaaccccagctgcatgcagtggctcatgcctgtaatcccagcactttgggaggccgaggtgggcggatcacctgaggtcaggagtttgagactaccctggccaacatggtgaaacccagtctctactaaaaatacaaaaaaaaaaaaaaattagctgggcatggtggcgggcacctgtaatcctagctacttgggaggctgaggcaggagaattgcttgaactcgggaggtggaggtttcagagagcagagatcacgccattgcactctagcctggcaacaagagcgaaactctgtctcaaaaaaaaaaaaaaaaaaaaaaaaaactcagctgcatccttcccagtcatgtgacctgggcaggttaagagaactccctgagcctcagttttcttgtctgtttatcaagagtcattagggaaactagtatctccttgggttgttgcagggattcaatgagatgacacatgtaacacaatcattacctcgggcctgtctcctataaatatagtgattgtcacgtttgttatttaaacaatattatatattgtgttttaggtattatgtatgtaatatatagtgtgaatatatgtatgcgttatgtatatagcattatctgacttcgtgcctctagtattacatgcttctcaaaatatctatagttttgtcggtatttctttctcctactagattgtgatcttttatcggcaaagaccacctctcatttatctctataccccccattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagttgcatgttactaataaggaatcagaagctcagagagggggaatgaaagaatccaagtatatgtggctaaaattggccacgtcgacacctgaaatcctattatctggggcaatatacatactgggtttgaaaaagttcacacttagcagttgaatgacctgagtcctcaccccagcttggctacttactcaccatgtgaccctgaatagtgccttgaagcctcagggtttttttacttctgtaaaacagtaactcttgccctcccggacacatgggatagtttgaagattaaaagatacattggctgggcatggtggctcacatctataatcctagcactttgagagactgaggcaggtggatcacttcagtccaggagtttcagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattgattgtaaagaatatagaatgcggaaactcatttttaattattaaaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcgcttgaacctgggaggcagaggttgcagtgagccaagattgcaccactgcactccagcctgggcaacagagtgaaactccgtctcaaaaaacaaaaaaaaaaatgcttccccacacccacccccaacgaacgaacaaacacacttaggaaatagggaagaaggttatgttttgggacaactttctatacactgagaaaatccaagaggtctccacatctacctataaaattcagtgatgctcagagctgacatgtcaatttttcctattacatagtaagaagctcagcattatgggccgagtttattggacactgcagaaattcatttacattgtgtgcttaccctggattgttgttgagtccagctgactgttgcttcacaaattaactgtcctttgagacttggaaatattgaaattgcatagagtttttgtgaaatctcaatcctgtagtattgtgtatattacaacaggtgctcaatagacttctggattattaaattgagtaatatttgtagcaaagatctgtaggctgaattataaagctaatctgtggggggatgccaagatttctctatcattctgctatgtttgccatggtctaccaggagatggcgcctggtaagagttccatattttaatgtattctggtccaaatcactggagttggcaaagatggagaaggaggaactgagcagttcatccccaaagacatgatgacaccactataagtgtgaagccagcaagagtgcaaagactgagagcagcgtggtcatacctagacatttatctggagagcaaaatcaagcactggggctcaaagggttcagtcccagcagttaggagagagaggagtctcctaggagtagttgccccaacagctgctagaaagtcctgatcctttttggtctgagccaaccaggtctcagcccagtcccacttgcctcaatttaaagtgacatttttggtctctagctgggtgcttccccctctgtagcatataacaaggatacactttcaaggcagggagcctggaggacaaggagataaccctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgctataccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgttggggtgtaacttaccatgattacatgttgtgatatacgagtccatctcagcagatagagagactctccttgacagcttgaggaaataagtgaccatatgagagaagctcatgaggcaaggagctgtgagcaacctttaggagctaaggacagcttccagcagacagccaacaaaaagctaggatcctgactcacatacccacaaggaaatgaattccgccaataatctgaatgtgcctggaaaagattcttccacagccaaccctccagatgagaatgctactcagctgacactttgattgcagcctgtaagactccgagtggaggacccagccagagtcatgcctgggccctcagaaactgtgagatagtaaatgtttgttgttttatgccactgagattgttagccaacaatcaaaacctaatacaataataccctttactgttttctagacagctgctatttagaaaagcctcccacccaataaaagagtcccctttatagttttccaagtaggtggttatcagggttctgcttcaccatcttcagtggcaaggaacttccatttcacagggcaaccatgtgtgtattacagaggcttgcatgttgtcaagttcagctgtggtcttcagcgggagcctaggacatgccagggatttcaaggtaggctggtgaggggttcctggttttcttggtcctgaaccatcccagtgccattctaacagttgcaagtctgcctccttcatgacaaaaggactggaggaaaatgtatctggcaagtcgataacactggatcgtttgctcccagctttaccacttggcatcagtgcaaactttcacccagttaaataacttaatgagccctgctctgcatgcttgcttcacagagttgtgacgatcaagtaagacagcatctatgacagtgtttgttggctgtaagtcagcaaatgattgcaaatgatgattattattaaaataatagtcatttgtcagtaaatatttgtcaaagctggtccacactgagggagacaggctctccagggaaactgctgatgcagagataaagaggagaccagccccagtttggaattgcatcactgattctgaattccccatggtacatttcaggtcttgcttcaggaatttgttttttgttttgtttggtaggaacaagaatcccctagagccagttatgttgtcatcaaacttagttgctaattaggcaccaaagcaaacctatgccagtgagacagagttgaaacttgaattcctttctgcaggtggagcgttggatcctagaggcggtgtatacagcttggctattttgatgcttctgcatgcaagaaggtttaagagaatctgagtaaagcaattagcatccctctgtctgcaggcaaaactggtttggacatgcttctctcttcttgaagggctgttagagccttggcagtgtatctgacgaaagatttcactaagcaaaatgtcttcacttacaaatccagccactttgcactctcagtcagcctcaaattcatttattttctttagagtttccctacaaccacgaaccaccaagaattaaattaatccccaagagcctgagcaattatgaggatgttgaatctatccattcaaggatgtcccagcaaggactgttcattcttttaacgtaaactatttatatgttttgattctcctcatttggaagaaagaaataagttttcatatatgtatttttcagggtgtattttatatatctgtttatattacactgttcacattactattaaagcatccccattttattgtaagtttattttgcctgcttcgggaagaacaagaccaagatcccattattaaaaccaaaatcttccacaaaagtttccttttaaaaacttagattaggaaattttcagtcagccagccaactctatagcctttgatacttggtcctacaaagttttcttcccctttggtctgaatgttttcctttgtctgtgcacactctattctcctgccagcatgataatacatgctgctttgatatcaagtggcgggaacatatagaaatgtgctattggtgctgcaatttgtatctttgttttcatcaaacttattatttaccattttaggatttttttgtttctttttgggtgtttttttttttttttttttttttggtgtgttttgtttgatcttggttttggttttccaatctaggcctgaggtccagtgctaatttgatgctagtgtgaactctctgagcctggttccttgacgttccattgggtgactattgcagtggttcagatgtggtgctaccagccttccccaccaaggaagttgcctgctttctcatctttgatcctcttcaccaactaaccacaacacaccagtgaaaattttaatttctccattcagttcctcagtttccgccaccaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagacccatatatcaattatttgcatccttcaattaacccacaagaaggcaaatttaatccagtgttagataaaataattattcacagggtcataacactattaaagaataagctatggccaggcgcggtggctcactcctgtaatcctagcattttggaggccgaggggggcagatcacttgaggtcaggagttctagactaccctagccaatatggtgaaaactgtctctactaaaaatacaaaaaaaaaaaaaaaaatcagctgggcatggtggcagacgcctgtaatcccagctactcaggagctgtagtcctagcattttgggaggctgaggcgggcggatcacttgactaccctggccaacatggtgaaacctcatcctactaaaaatacaaaaaaaaaaaaaatcagctggtggtggtggcagatgcctgtaatcctagctactcgggaggcggaggcaggagaatcactcgaacccgggaggtggaggttacagtgagccaaaattgcaccattgcactccagcctaggtgacagagtgaggctccatctccaaaaaaaataaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccattcttacctaacagggaagctgtccataaataaggtagcaattcctgaatcaaggacaagccttctgcccagtctttatatgtaaagaaacagtagtttcatttgaagggaaaccattataattgtctcagatgtgcatcttgttccagggtacttctttgtatttttgatgaggaaccaaaggctttattatagatcttgtgaatacctgtcagccaggatttagaacaaatgcatttgggcaattttgccttttatttcagataaattttatatgttgtttctgtccagaattgtaggatcatgtttggcttttcaaaactgcaggaaatgtttattttacttttctttaaagaagaagacagtaatgaaaaatgtatcgactgccagcccactgtttttatttctctttgtgtgagctatggcttctccacatcttgagccttaaactctttgatgttgtctttttaagcataacataaaagattattccctttagtctgtaggcttggaggtgggcaaacatgacatattcctgggtattcatatttctataacaataattgatgcaggttttggggctgttgtatttgccgtagccttatatgataaacatttggcattccatgacgtttcagctttgtcaactttccaatcctgtatggagttccctcttattgtttctgtgtgaacaacttgacaagagtggcatccgtggtcagattcttcactctatccctgcaggacttttcattgtgctctgcacacgatggaggctcaatgcatgaatgaatgcatggatgaatttttcagtttgattccgtgagctgcttaattctattagatgcgctccctaggcttttataagacgtttaattggtacatgtttcttatcactttttaatactccataagtgttttgtgttctttgcagtagagtccaaataaatataaattaaaatgtttccaattacagaggaaatattttcagtatcttcccacaaataacactgggtttataaggcttggttcccgggtttcatggtcatgcttggttgactaactttgtgttcatgtggcataagattctaaactgtcagaactacgtgggcttttagagcccatctaaatccttctcactcacagacgagcaagctgacatatttgcctcatttattggcagtgaatgaattaaaatattgtgccttcatcaagatattgtgtgtatattcacaatgttgtttttcataaatatgtagcattactctgttttgtgactgctcctagactggctggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacataataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccagaatcttttccacctttgagattattttaaatatcatcattactttgagaaaagcaaacttaacaaggatgccttaagaaatataaaggtgtcattgcccaggaggcaagaaagggaggcagaatggtaatgaaatgagacagcccttgctttggttttataagatctgggtctgaatcctggcagtgtgttctttctaactttaggtaattcaggagccctagaaacctcatctctctatctagtgtgggaaaacgtgaaacaactttgggccatagattgctctatgcaaactcaacatatgcaaacttgtcttattaaaaagcctatctctagtggttcctatccctagtcttgtttggttgggtagcttccaattaataacagcttcaaattctggctaatatttgtttagcacttcatggcttacaaagtacttcattattttaacattgtagtattggtaataatatcaaactttctgttattacaataaatgttccttttttactttattattccattactttattactgtttttcagatgtactgtgatctacattttacggatgaaaaaaagattctaggaggataagggactttgtcacaaaagttagcttctaaatgatggggggactcatatgcaccttttgaaactcctaaacccatgttgattccccaaaggctttggtggtcctaaacatttgacataatcagagtctattataaaaaggtatggcttatccagctcctggttcctcactgtctcctctatctcaaaatattctagaaaaaactttactccctgaaaatatacagctttaggataggtgcagctccatttcatactctgattttcattcctcatttgaaaagttgaagcgtaatttcttataagactttagaagttgaagtcaggactggataaagaaaatgtggcacatacacgccatggaatactatgcagccataaaaagggatgagttcatgtccttttcagggacatggatgaagctagaagccatcatcctcagcaaactaacacaggaacagaaaaccaaacaccacatgttctcactcagaagtgagagttgaacaatgaaaacacatggacacagggaggggaacatcacatactgggtggggcctgtcgtgggggtcgggtgcaaggagaaggagaggattaggacaaatatctaatgcatgtggatcttaaaacctagatgacaggttgatgggtggagcaaaccaccatggcacatgtatacctatgtaacaaacctgtacattctgcacatgtatctcaaaagtaaaattttttaaaataagaagaagttgaagtcagggtataggaatcacaatttgcagtgctatctttcacacttcttaccacctgatgaaaatcaccaaatagtatttcttcttttacctaacatctctaggaaagagagaaccctgactgcacctacaagtagggaaaggcatttgagttacgcaaagctgcttttaactctgaaactgtcctacagtgtagcatataaacagggaaaacattttattggtgttttaatagaatcttatctaaatatctggaatcttactgcaagggccgatcattactctaggtagatttcaaggcccacagctccattatgatgtcaacaaggataactgatgtttattctgtagttagagcccccaaggcttcagcaaacattttgctcatcacttgtaggactagcagtaaatgtaatcattgcaagactgagctaacacatctgctaacagggttgttcatttgagtaaacagcaaggtgataaggcgcagggacggaccattggattgagtcagacaggcccgagtacaaaaaccagcctcactacttaaatcttacatagcccattaagagtaagttgcttcactttgggaggctgaggcggacagattacgaagtcaggagatcgagaccatcctggccaacatggttaaacctcatctctattaaaaaaaaaatacaaaaattaactgggcatggtggtgggcgcctgtaatctcagctactcaggaggctgagggaggagaatcccttgaaccagggagtcggaggttgcagtgagccgagatcactccactgcactccagcctggcgacagagtgagactccgtctcaaaaataaaataaaattaaattaaattaaatttaaaaaagagtaagttgctcaactttttaaactttagttttattatccacaaataataaattataaattgctgctttacatatatgatataaaaatgcatcaatccagttaatttggggtaaatggtattattccagtcttacctcctagaatactcagaagacacaacggtgtatcactagaaggagatagttttgttttggtttggtttggtttcttcagtcttctttttcctattccttccttttccaagaaacccacgatttctttctttctttttccagctattgatgaggtcagggagtaatatgttcagatctttgttgtatctttgttccgtttagaaaccagtatctgggaattcaacagagaatttggggtcactggaagctatgttttacctacatacaactacatcttcctcttagacctagagactagatactgaaaatgcaaaaggaagccatattgacactcccaaggataagggaaggcattacatcatcctttgtaatggtgaatcttgtgcatttgtagagggctggactttggcttctaccatattgtttagctctgtcaaccccacacaaggactttatttatttatttagacagagtcttgctctctttcccgggctggagtgcagtggtgcaatcatggatcactgcagccttaacatcctgggctcaagtgatccttccacctcagcctctcaagtaactagcaacacaggtatgtgccacctcatctgactaatttctttttaattttatatagatgggatctcattatgttgcccagcctggttttgaactcctggccacaagcattattattatcctcatcttacacatgaggaaactaccagtgaagtggcttgcccatcatgtgaaattacatatgccagtactagcctgttctgaaatccagcaacattcttttccacctctagccttgtttctagcaccctttggcctccagagcaagctggggttcattttacattaaaagtagagccatctgatgtggcgggcatccaaaacacttgggaaaatgctactctgtttagaactcgcttttcttcctcccgggtcccagtgcaggaggtactgtgtgctatgtgggccatcagactgtccctggccatggcaggagaattaggagaccaccagggctgtagttaactgtaggtccttcattaagaccagccaattgatagcgtgtgttcatgagtccttgtgaagtcttttcatcagccacgtggaagaccccttagaaaaacaatctctgtaatttgtatttttggacatagtgctttaggaaggtggatgtctgaaggtgggctgggtttgaaacatctctcaatgccatgggacagtgtggtacagtgtcctgacaacttaagctcatcctgacaacttaagacactaaattctactcctgcctcttctagtctagttggtcacctgccctttctgaatttgtttttttttttttttttgagatggagtcacgctctgtcaccaagctggagtgcagtggcacgatctcggctcactgcaacctctgcctcccaggttcaagcgattctcctgcctcagcttcccaagtagctgggattacaggtgtgcaacaccacgcccagctaatttttgtattttcagtagagatggggtttcaccatcttggccaggatggtctctatctcttgactttgtgatccgcccaccttgggccactgcgcccagccctgaatttgttttcttaactacccatttatttgcttgaaacagatgacttaaaatattccttcctcctctgaagttgttctttaaacttttctatgtaagaaattgattgagctgtattcctaggtattttattctctttgtagcaattgtgaatgagagtttactcatgacttggctctccttttgtctattattgatgtataggaatgcttgtgatttttgcatattgattttgtacgctgagactttgctgaagttacccaccagcttaaggagattttgggctgagacgatggggttttctaaatagacaatcgggtcatctgcaaacagagacaattagacttcctctctttctatttgaataccctttatttgtttctcttgcccgattgcactggccagaacttccaatactgtgttgaataggagtggtgagagagggctaatttacattcccaccaccagtgtacaagggttcccttttctccacatcctcatttgttttttccagaagacagcatttgctattacctgtcttttggataaaagccattttaactgaggcaaaatgatatctgattgtagttttaatttgcatatctctgatgagcaatgatgttaagcagcttttcatatgcctatttgccatttgtatgtcttttgagaaatatctatccatatttttcgcccaattttacatcagattcttagattattttcctatagagttgtttgaactccttatatattctggttattaatctcttgtcaaatggatagtttgtaaatatgtttccctttcactggtttttgtcttcattttgtttgtttcctttgctgtgcagattaacttgatgtgatcccaattatgcatgtttgctttggttgcctgtgtttgtggggtgttactcaagaaatctttgcccaatccaaagaacattcatctttgtcaaatgagctatagaattaatgtttttcctatttttatttattcattttatatttatttctattttatatattcatataacaatatatttattcataatatcactttgaatatcatttgttttcatcttgcatttttctcatttttcattgaggcctaatttacatgcaatgagatactcagatcatgagtcgtagttttaggagatttggcaattgtatatattacccaagaaagttcccttaagttcccttattcctctttctattcaagtcccatctgccaccctcagaggcaatgactttctgacctctatcaccagaaattatttctatatgttcttttaaatcagataagaatcacaccatatttattttttgtatctggattctttcattttgtgcagttgtctgagattcatccatgttgttgtattagcagtcttcatctttttgttgtttagtatgccacgattataccataattaatttacccatttttcttttttatcataatcttatataagggaaaaacatgggaatacatgaactgtatctttggctcaaatccatcttctatcagttctaagggcctcagggtatttgccatgaggggctgtgacaccagcctggactattaggaatggacctttgcttctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccctctctttagcatttctgtgaggaagtatccaaagcattggattacttgagataatatttctggtcctcttcctctctcacactctacactttgcttttctagaattgaagcctggagaagaaatattgtctaaagagcttgctacaagaaaatttccctaaaaagtattgggtcttaaaatttcatctcattttcaagttcttagaatactgttaatttgcaaagctgattatggatggcatactttattatgctttttaatcatacttcaaaactgcactatggatttgttctttctgtcttcctcccatgcttaatcattatttttggtggcaccttctaaactgttgacttattttctttctttctgatttgtagtagatgttgtataatctaagtttaggcagagatagtgaaagtgctggcctgcctgtatttcagccagtcctgggttaatattattcatgtggcaatgtctgttttactttaggactcaacgtatttaatacttcctctcctcctctttacaatacatagaggaaaggcctttgaaacataatttctctccctatgggaaatgctttctataaatttttcattttcaatacaaactgcttcactttacaaaacagtatctgtccctagcatgaaaaaatactggagggatatgaacagtaaaggagaatatttttctagcttgtgttaaatcaataatgtagtgattccaagggaattgagaggttcgtgtatttattcatatattagtcaaaaattcaaaattctatctctaattaaaaaggaatttgagaagtatctaccatttttattgtccatctctttggacatatgctttgcagcacagtggagcggaaggagcgtagacctacagaaatttagagggctaaatttttaatattggcctggctacattgcctggactttgggaaaatcacttaagctctcttagccttagtctttttatctgtaaactgagaataataatgccagtttttcaaggttgcattgaggatcttaggtaatacatataacattcatggaacataaaatgtgaaccaatgaaggtgccaatgcaattacaccttcattaggagttgtcatttctgcggcttctcattagaacatcaaaattagttccttcaatctttactgaggcgcagagctttaaactctaactttgaaacttccaaaatgaagtgtgaaaggtctgaggccttgtgagtttgaaaatgcagttcacacttcattttagaagctccagaattttttaccaaattgagattggattcaggaaatcatattttaaagccctggttcatgccattttctaaagaagtacctagaaggccataatcagaatgcttattaagtgaccacactttgaactgcattgcagataaattacctctgtgtggggagatgtgtcttgagattctgcggtcaaggctcagacagccccagagctggaaacctcagagcatttatgcctctgtcactaaaggatggggttatgggggctggacagaaagcttgagagagatgaaaagttcagtgggcttgagggaggattactgaattacaataatatccacaccgtaaagtgaatttgtacttgcaagagacacattatttatctagaattttagaaagggtctcttttcaggtcactgtgtagattgcctgtgatttgttctccttgattgaatgtgagtgagtgtgaagcatatctaaacaggtctcacagcaagtttctttcataaatctcctctggtatatatgctgtgtacccttgacaaggagaacactattaatggcgacagtatgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcgaggctttgtctttgtcttctaagcttgctttcccctgtgatgtccagtctctcctaaaccagataaggattcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccgtctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgacagagcaagattccatctcaaaaaaaaaaaaaaaaaaaagagagagaaaagaaaagttacatgtagagaactgtaagtaatcttatctggctagaatatagggtaccataggggaatgactgagcatgggtcagagttgtaaacatccttatcatgccaatgagttggatttctccagaaggcatagagagatctgtttatagtttctaggtaagaaagagtttatgaacttgcctgtgtcttcgaaatatgctgtggcagaatagaaaaggtgatcaaccagagtaggacagaggccacacacatctgccctgaggtcagatacctatacatttattgtgtttgatagccaaatgattttaatgtaaactagttgcaaacatttaaaatttgggaaattttacataaaaatctagattttcgagcttctattaagaagtagagtgcacaatatctgcctagcaagaaacagctgttgctgagaagtgtcttccaccttcagctagagcatgcagtctgacatttgcttttctggttcttgtatttgagtgtgagactcttggagtaaagcaaacccagggtcagaaagatcactggtgatgatgttgcagttgtactgtcaggactgatgaaaacctaaactaaggtggaagccttgaggaatgaagaggagggcaaggatggatttgctgattgtttagatgtgtcatggatgaaagagatggagaaatcaaagaagactctcaggttgtaattttaggtaactgggtaggattcccatgtagtcagaaacccagaaagaagagaaggctttgggaagatgacagtgtattcaatgtggctttttgtggttcaagactttggaaaatattgattagactgttgaaaagtacttataggtcaggaacctggtcagaaagtattgtgctaaaataatattgttatgacccaagcagttgtaaaaataacttttattgtctaactctcacagtttatcttgaactcttaacaggttgtcaggcaaatatctgttcttgaaaccagaaaaacaaatcaagaaattgggatatttgaaatgcctagagtgggcttataactgtaaatgatattttacaatggaaaagtagaaacagtctttagcagccaatgtgaaataactgggtaatgttatttaatagaatgcaaatttgaaatgagtgataaccattatggagaattttgttaggaaaaaaattaataaagtgaatgtaacacatgaagcagagctggaactaggaagaaggaagtcaggctcctggggaaccaaattaaggagacttcccctctcaggcacttgtgggaccctgacggtaagcatctccttaggtactgctcccatcctcatccttgccttgagtttttgaaaaatatatgttagaaatgtttatgattatatatcacaaactgttattctcaattttatgaaattccctagatatgattacaatagtcatttgagatttatgatcttatctaattgttatgtatgtacccattgtggggtgatacaggcagaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactatttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgcctagcatgcgaccactgtggagtgatgccagacggctgtgccattccagtgcactgaggacggagggacccttttcctctgaggacacatcatttcaccttaacccctttggccagaacaaagttgcatagctgcaaggacgactgggaaatatatttattctgggcagccatgtacttagctacaatttggaggttctaaagaaagaaaggaagagaatggaaacaattttcaaggcctaccacagcaaattggtgccatttctaggactagtatcctatttcctaactcctagtagaatgttttttctataccacagatttttaattctcataaagatgtgatttttaattaagaagcctataagaacattttgaatatgcacaaattcatcattttatatgtccatacgggatgcagtgattcccctttgcttaagatcaatttttgtttttattaatcccttgatatatagataggagtcaggcagacccaagtttaatttctgtctaccaacttgtgactttgggtccatatgaataaaaaaatctatgctttgattttgttttttcctctctaaaatagtaacaacatgtcatcttggggttgttttaaaaattaaatgggatgatattaatgaaagagcctagcccagtgtttagtattgaataggtagatatctaatggtacagataccagtttccttctttctcctcacttccttaggttccctccaacctgaagacaacgtatgtttctcatagataattacaaggaatttaaatccttgacaaaatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcacttaggcaggtattgtgattatctaagtgagagatgatagaacaatatggcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatgagccaaactcaacaagataaaatctaagagggtcaagtcaaatttcattcttacctttaaaagttagctatacaagtacatcatataaatgtcatttactttgatagctgtttatattttttaaaaaaagaaagaaaacaagactggtagagaagatagtctgaccgcaagatcaacaataataataataatgtaggaccacagaaaagtaaatgaaatcttggactgcattcatctaaagaggagcatgcagaacagggaagcagcagtgcctggagtgctgagttcagttctgggcgccacatgatgaagggaacctggataaactagaccttgggcagacaaaggtgcttgggagagtgaggtgacagaaatttctcataaggaatgatggaaggtatccctttattccaataaaaagaagactaaggaaaggcaatgttttcagtgctctttagggctgttaaattgaaaaggcaacagatttgtctggagaggacagaagtagggccaatggggaagaagatatttatgtcaaaataagaaagctctaacaattagacctaccagtggaatgaacgaaccaagagagtgagctgtccctggacatggtataagcagcctcaggggctggaaaaacactgactgactgggaatgttgtagagggaatttatagatcagattgattggggaaaatagccccaaaggttctcctctctctgacatcactctatgattctatgtgaagttctagctttttaactatttttttgtataattaaataatttgtctttattgattgagaactaatcattaaaaaagctactgtcttttcatgtctagagatgataagaataatactacatgcttttgaagaaaaggaattttatgcaaataatcccataccagtgtattacgcttttgcagggataatcaagagcttgcaaaatttgaaaccacattttcccctgtatggaggaggaaagtctattttgcatccgtactttatgccttgggcattattattgctcatatgctctaggatttttaataaacctaacctgcttcatgaaattacactgcattaattcaacatggccatgtccaaaatttaatattcattcatttattcaagtatttattcaacaaacaatccctactatatttcatgtgctattgtcagtgctagaaacatcaatttaaaaatgtttaaatcctagtcttcgaagagtttataattaaatataaaaatattgtctatgtgtcaattactgtagctccaaatacctatttactccaaaaattagtgtctgaaaggaacaatcatttattatctcttacagtttggtgggtcagaaatttgatagcatcttgggccaggcgtggtggctcatgcctttaatcccggcacactgggaggctgaggcaggcagatcacttgaggccggggagttccagaccagcctggctgacatggcgaaaacctgtctctactaaaaatacaaaaattagccaggcatgatggcacgtgcttgtagtcccagctacttgggaggctgaggcatgagaatcacttgagcccaagaggcagaggttgcagtgagctgagatcatgccactgcactccagtctgggggacagagtgagactctgtctcaaaaaagacaaaaagaaagaaagaaatttgattgtgtctcaagtgggcaagtttggcttggggtctttcatgaggtttctggtgtgaggtctctcaaaggctgcttctccttacacctgggccaggagtgtttgaacagctagtctggaacaacttggggtcttcaggtatctccctctatctgcatgtggtctctccagctttgggataacctaacttcttacatggtaactgctatagtttgaatgtgtcctttaagttaatgtgttggaaacttaattcccaatgcaacagtgttgagaagtggggtataataagagatgattaggttatgagggctctccccttatgaatggattgatgccattattttggaagtaggttagttattgagagagtaggatgttataaagtgagtttgactccctcttgctctcttgctgtcatcctctcttgaccttctgccttctgccctggaatgacacagtatgaaggccctcaccagatgctggcaccatgatcttggacttcccaccctccattatcataaaccaagtaaatttatgttgttcaaaagtgacacagtcagtggtattgtattatagcaacacaaagcaaactaagatagcaactgaggacttcaaaggtatgtatttcaagagaaaactatatcacattttaagattagcattaggagggctgggtgtggtggctcactcctgtaaccccagcactttgggaggccaaggcaggtggatcacctgaggtcagcagttcgataccagcctggccaaacatggtgaaaccccatctctactaaaaatacagaaaaaaaaaattggtgagcacagtgtcgggcacctgtaatcccggctactcaggaggctgaggcaggagaatcgcttgaacccgggaagtggaggttgcagtgagccgagattgtgccagtgcactacagactgggcaaaaagagggagactctgtctcaaaaaaaaaaaaggttagcattagaagtcaggcagcatcactgctatgacattctcttggccaggcagttgcataggttctcccaagacctcacctcttagtggtggactgttagtatcacattgtgagatgggatgtgttttggtgtagtcatctttgaaaattacaacttgccatagcatatgaacagataacactatacttgggttctctgctatggtgctgtgaaagaacagaagaggagagtgattaacagaagaggtaacattcacatatcatgggccatataatttgatgtatgtaacttgttaaggaaatacgttcaaggcaggggcaacagcaggtggaaaggcatgaaagaacaatgagcacaaagtgtttaaaagcttgggttgacaggaacaaagactgagttgtaggagaggtgacaggctaggggcctagacaggggaggtaggacagcatcctgaagggccttgaacatcaagttaaaacgtttggctttggggagcagtcactgtctttagagcacaggcatataaactgatcgtctttggtaatctcttccatctacaatctttctttcctttgatagtaaacatatcatctctgttaaagttgcttcctagcttaaactgaacacagactccaaaccattgaagcactttagatttttttcttttttttttttccttttcttttactcaccacaaacaactctagaatggcatgcatttgaacaaaccaaaagtgatttcactcttctaattttcagtgctttttggctaaatgcagagtgagaaattcatacctttttcaagcagtgtgggttctttttcccaatttctgtcatccatctggttctctggaggtcttggaatccaggaaagtgttagttcactgtgctgaaatccaaaaaagactgctaaactgtgaaagaaaatttgcattccagagacactgaaagagttagtccaccacccttttgcaacagcaaggagaaaacatctgtatttcctgcctctttgtctttaagcagttatagaatggaaaaccctatactccctggctgtgcgtttcatacctagttaatctaaatcacttttggcagggtgggggaggaatcaaaacatggaattattttatttctagtgtcagaaaatattacagccaagatactgtttaagggaagcaaattacttcaccagcttccttttgagctcctcatgaggtttaattctcatgaatgggtcctagagccgacatttgacatacacatcagcagtgccctcttcggaagggaaccgcacagtcacagccatgatgttggcatgtctttatggccttcctaagtcatgtgctgtcttttgtcttccattggcagaaatacaattagaaggccttgttctcaacagaagccaaatgattgccaaatctgttcaactgatctctagagaattgaagttagctcatggccctctggctgttctctttgccactcccaggagttataggcttaaagttatccctttcttttgaaagaggatcaagtttggttcaaagaagcttttctatcatccccaggagtacaaagagagcccttccatgaccctagttgtttggctcagaccacttatagcttactgtaatttaggaagtaattgtaattcataaagccaggtagataataaacatcttggcagggttgagtttcaggcagctctgaagggaaccaacatgtgagtggaatggtattgggaacatttctagtctctgcttgcagatcttgattctaatggatgactcaaactggtttaattctgatctgaaatgtgcaggcaggcagtcattactctgtatacacatagctgaaaacatcatcacttaagcatgggttttagacattctcctggatgagttagttacccatggtagacaaatactgtaagtaaaaagagcattctcctaatttctatgttgtgtgattaacttcagatcatttatattcctggagaaatatgtagcactattttttctttaaaagatatattcttgctgaggtagaataaagaacagaaaagttgtaagaggccttagattttaggttatttaatgtcatttaattttgtattcaaccaatacttactgattgcctgttatgtcttaagcgctgccgcagaggctgcaaatgcagtagtgtcttgaacaaactagtgtaagatgaacaataagcatggcagaagcatagtagcaactaaattcatgaagtgatatcatagtgataagcactatgaagaaagcaacaggataaagagacagagtctggctctggagagggggctgctgaaatagtgtggtgatgcaggccatctgaggatagtaatgaaatttgggggatgtctatgggagtagatgctgttggatgaatctttggagtactcccaaatgattgttcattcatttacttactaaaatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaatttaggcccagggaggaaatgctttgtacaaaactcactgctggtggctgacgttggcaagactggaatacagcccttgacttctgctttatttctccttgccactgagccatacagagtctctgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcgtgggtaccaggggctttgttggaccttgattacggttaagtcaagaaaatggaccttgccaagtataactgccgcaaactagacagagaactgtatgagacttcttattggctcatagacttctctgtacacactctaaatgcatggtatgtaactactccatcacttgataggcattccaggtatgtaaactaaataagatacatggcaagaaaaattacctgctgaagacaaaacaacaaaaacaaaataatctgtatttttccaaactcaatattcaatattcaagggagtatgggtacttgtgtatatattttatacttgtctacttctctccagtaataagaatgatagaagttggctcagttgattagtcagaggctgttgaaccaagatgtagggtcgatccttctgtgtaacagtaattctctccagcgaaaagagctttataacaatatctttatatctatttacattcttaaacagtgcttctcccatttcttataatatttaattctcattgttaagagattgttaaggcagaatacttagtatcccattctatagatgagaaaattgacacccatgtagcttatggaattttgttcaaggtgctgtgaattccagctactctggaaattcactgcctcaatgaaactggtctaaatgttggttaatagcctctatttataggttgctgatagtaggaattatgaaagctggacctaaggcttcctaatgtgaggctttggataggattatctgctctgagctcttagccagaaggcccccatatttatcagtgtgcaacaatcttgttttgacagcgacaaaacccaagtagtgtcacatactcagcttaacaatttttcattggctatgtaagtaattatgttaattttatcatattcttattgttaagtgggacagaacaccagggagatgtgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcggggaatttttcaagctcaaccaaactatgtatttatgagaggctatgggaaatctgcatgctaaagattattaactgcattctgaataattgcctttatacagaataacggagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcctgtttgtgtacatttagtaaactttaaggattgtaccaaatcaaagtatcagttattatttttggtgtataaaggaatataaattacttttatgaagaattaagaaatgtatggatttggggtataataaggtttacacagaagaagagctttttcacaaaattcccaggaaagcagggggaaactcacttagaaatctagaagcccattttatattatgacattatccaattatcccagagtatcatatacacaattccttagataatccatttgttgaaaggacagatataaaatataggagaattaatggtgaagggaaaaaatagaaatacggtgcttcagtgtggtagttacattaaatgatcaaaggatgacaagttaattgaataaatgtcttagccccttgaaatttgtatagggaatttataaaactaacatttattatatagtcaggactgggttctcgctttgataatatgtgaactcatttaaacctcacaacactgcaatgtagacatttcagtctacaaaaaccaaaggccagaaaggtcaagaaaattgcctagcttttcgaacccagatcacctttttcctactgtttcactaattctcttactataatatggcagaccttctttgatgtctgagttaataaatcttcacatgacttatgttgtaaaggcaaaatctatcatttgacttgtctcggaaggaaaggaactcaattcttttctttctctctcaccatagtcttagtcttctctgatatgttcattatgcccatggcatgagggtctgacccacagtcctcagctcttaggccccttccccctgccccacatttttcaaggatcagaacacattcaaaagaagtgttttggaagacctagcatgtcacatgggttatgcattttaaagtaaaatattacctctccgggcattaaggtataaataaactaaatgttctataattgagattttcttttccgatttagtaaagctcagatcacaatcctaaccctagtgcttaagaataaaaaacagggcgtaatttactttgtgaagaatgtgatttttagctcatggcaaaattgaatagaacggcctaattgctgtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagaccagcctggccaacatggtgaaaccctgtctctgctaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatctgcgactcctataagagtattagatattaaagactcttgttatagcacaacattaattccaaagtgggttaaaataagttttttttcaagtgccaaatccaatcccaactagaatagattcttaagagtcatagaccaccaccatactgcctgctctctcaccattcataagtaattactctcttctctgcattcccatcattcattactcgtgcctcaatgatagcaatttgtcatgccctttgcctcgaatcagttgttaatagttgtgtccacctgtctcactgcattgagaacctttgagggcaaggatggcatctttatcttccatctcttcctctgtacctgccaggctgttgaacactttgttccattctttaggctttctgcaatattagagtaagtgaggaggcagctctgctctttagagaggcatataagaagtttgtttaaagagagtttataagaaaactgaggcaatagatgcaaaaagttatgctccaaaagattaacaaaaaaagttgaaattatttcactgaattttcagttctgtgtttcatagctgtcatcttcaggggtaggggggtgtgtcatgacatcaaaaaagtacagtttagagatttgatgctatctattaaattgtttcaaaacgtttcctatctatcaggaaaactttcatctgtaaaagaggaattttgattctaattgaaaaatcacagtcataggggtgggatgctgttaagcttgagattattattttcagtctgtttcaaaacacacattacatgcagatacaaatatagacttagattaagatatagacaaaggacattagaaagaccaagagaaatgttaataaaaagttcatgtctcacaggaaggcagagctgttggaaggttatctagtatagggtcattagaactaccaaggtaaaatgatatcttcacttgcaaagcaaacccaaaagtactgccatcatttgggaagcaatcttgatgaccagaatcaaggtagagaataagtttttattccataattaagttaggcaatagcagtattctgagttcagataatggcactggcatttcaagagaaattggctgagtcatagccctgctcctttactgtaccacattaccattctgttgggaacacctacacttgagctgtacttcccaacctttttcacatcccagttcatgtggaaaatgatggcattcattcagcacacggagtaagtggatgagatctctcctgtcctgttcctgaggcaaccgctcaggaactctggacacctctggtccttccgaatcctcccaaatatggtgcatccggaacccacttgaaacacactgtgtgttaacctgccagttgagaagttctagactggagaattgttttgcatggttaaatagaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatttatttgcatgtaacttgcagatagcaagcctgaatgtcttctttctatttgaaatacagtgtgtgtctaccgatatacagattccatataatgtgatgtagcagagagagtctccattggacagagaattaggagacctttattgtaactcccaatctgtcactagctgtgttctctatctataccttagtttcttgaatccagcagttggactagaatcatggttttcagatagtacaggttccatcccttcatgcccttcagccagaagtgattttgggctctttaatatgtgctttttttgataaattgtttccctgaagaaaggattatgggtgaatggccaagtaaaagaaggtgaaaattcctgggctagtgtaatctctaaagacttttcaagactgaatgtcttctaactctctctttttttctttttgttcttatctcaacaagacctaaactatctagatcatgagatgtcactccttatctttccaagagtctttcctgtttcacgatattgtttttgtacctaaaaaaggtaaagatgaatataagatcacattttaattttataaaatgaaaatgttgttaacatttccaaatggcagtaatcactttatagtcttctgaatcttcaattacttatgtaaatgaagactgtatatcttgattttaaatactcaaaattgaacacttacatatacctatgtaatatgtaaataatggtaatattcttattctttatcatctcattagtagttcacgtttatgttatctatatgcttcatttatattcatatgattcttcagctcttctgcctgtgagttacaagttatttatacaatatccaaagatagaaaaaaatactaccccattgtatctctgacttaaaaacgttgcatttgggggttttctgtacaaagttgatttgtgatttaattgttagtttcactgagtttttttgtttttagtcacaattgtattgccaacatttcagaaaaatttataagctgtgacttttagcaacagaatctgcttttttctgctactctacgtcctttcattttaaccatactttcattggagtagcctaaaacatttttttatggaaaaaagtcctcaaacagtgcctgttgcaaaatgaataaaatttggattcttcattcagctttggccaaaggccttccacagctcgttaccaattacttactgtgtgtcatgaactttgtagtccctgggcaaggatgcttactattgtggataccgtagatagagtgtacaataggaataggaagtataagaagtataaggacttcctatactttcccacaggtgttgattgcaaggacacttcttgataactaactgtgtgcaaatctgcttcagaatttgtttcctaggaaacacaacctcagactatggcttcatgggaggagagaggagtgattgcagtttagtcatagaggttgacataaaccactaaatcaagtacattgtgttcagtgtcataggggaagcataatacaatcctatgggagtggaagaagttacttacttttcttggaatacaacagaaaaagatttaggaaagatttttcagaagaggtgacatttgagtttcactttgaagaatgagtaggcattctctaagcaaagtagaatacaagatagtctgggctggtaaaagaatgttgcttattaaagatgtggcagaaagctcagtgtggcagctgggaggaggagtccatgggaccacgatggagctggatcagcagtccagtcacaaagcacgctactgatattgaaggttcataagctggaaggtgctcttttcttttaaatccccagctatcaatgctggcaaccctactagacaaaaaaataaataaataaataaataaaagaaaaaagaaaagaaagaaagaaaaagaaagagagagagagagaaagaaagaaagaaaaagaaaaaagtgatttgaataggcatatttagagacatccctctttcacttatttgcttaaagactttcttttttttcaaaaccgatttatttgtcaaccatttcatgtcatgggttcagatgaatccaatatttgtatgaagcgtgcatctttttgtctggctttaaaataatcatctataacacaaaaatatccctctatgatccttacaattttaccattagcaatttctagaattatcagtggaggtgcatagtaaaggtaatatagtccaggtttctagcaaatgaatgcccctttcaaacctctgataaggggttatccagttgtttttgtatatttctgataatgtaaacatgtatctttttctattgttgttaatactgatttatcacagattaatacaattacagagtttgaattaatcatttttcaaatgagaaaactgagatcgaaggaataaattatttacccaatgtcatacagcagattttgacaaagccagaaggataattcatattcttcacctagcaactttcctttttcatggccacataatgaattccttagctccctctctgcattattaggagtcaggtaactggggtaccagtcccacctctgcatctcatgctctccacaactcaggtccagcacatccattctcaaagtctgcctgctcacctgtggaatgagagtctggactaagggaactcccagccccctcctcctgacactgtgagtttttcctttctcgaaggctactggtaggccccactggagactgaaaggggaagattgcagtaaaaggcgcaggctgtcgaaggataacatgtccttctacatcattcactagcctaggatgccagtcaacttcattcttggaacctttattttccaatttgcgggcattttgcaataggctgattttaatcacattttatactttttttcctttgttgcagaaatgtttgtattacctgttctttgaatgcagcatctgtagaccacaaggtctttccataggaactaagcctgttatattgctgctagttttgagtaaatgagctgaatcttgcagccaagcctcagtgcaaacaaaaacattttctggccaaacattttctggttattcaactccattacagggctgactaaaaaaaaaaaaaaaaaagtaaaaacccacagaggagcaaaacacaagtcctgggaagacaatttccagccacattagctcacattgtcagggtagaaaagaaacaggccctcattcttcaaaccatcatcatctccaaactcttaccctgtgctcttctgctattttaatttcaccacttcaaaatgggaaaaacaaataggttaatagtttccatgcgtttagactgtgaccagaggcatacgaagcaatttcagaacctcaggcaaccacagctttgagggaaggatgatgatggatttaccaattcatcttgggatggattccagagttaagggagtcaggccagcactgtgctgccagagtgggatataaacaatattcattcgttcattctttttgtacacattcatctcaggcttatttctatttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtcaaaatggcaaattgcgatacatctaggcattagccaaggcacagaagtatgggagtttcacataggtttgaacaagagtgagtggtctgagatgttatgagaaccataaaggggggttggataccatgtaaagaataagctctttttacattgtgaagccattaagattttattatccagaaaggtacttgtatttgatcacatctgtgtttggaaagaaaactggaagtcattggagacaggggcaaggggagtattataagaagagagatacaaagaagccaaatcataggtcattgctataggttagacataaggacactagttacctacgtacagacacttcttgcttcatagccatttatatatcctcatggtaaaagagcagctacccctgaatttccacatcccattcagttctgcatctttctaataagatccacatcccgggtttattcctgattgtaaactcaatgagttaatccagatacctcagttgtaatatagcattttacatgtgaaacgtggttgtttgctaagagcatggaattaaagggcaggatggaaagttaacagccgatctttctgagacctgactcactaactggtgtctcttttaaggggtgctatatatttttaaagcttagaatatttttaaggccagataaatgtgtttcttaattcactttttcaaaccagctcccttctacattcaacatttctgtcaagagtttgcaaactctaaacttggagatggtgtgtaaatcaaagctttaaatgatcagaagcctaattgattatgctgagttctgatttgggttctgcatttagcatgctctgtctcagtcatctgacaggctattctgtaaaaagtaggggtcttagtgatcgcactatggtctaagtggtcacactatgtctttgataatgaatcaagttttagaagtaatagtgaagcattcctcaatcggtgaaccagagtggtatagttcaagggtcaacaaactatgcccatgggtcaaatccagcccattgtctgttttttttttgtaaataaagtattactggaacacaagcatgcccatatgcttgcatgctatgactgctttccagctataatagcaaagttgacttgttacaacaaagccagaaatatttactatatgggactttagagaaaagtttgccatcacccatgctgtaggaaacaagggaaggaacaaggatagcagtcagaaaacacatgtcctcagttctggacttgccacctactacctgagtaatactagaaaagccacttgacccatctaattgtgtttccttctctctataacacacttctttggccagtttgttagttaattggccgataacacttgttttctatttgtaaggactgtattaaagctgtagatgtggtttgtaaatggtgataaatgccttccttagagtggtgtgataaggacctgagacaatctgttttgtaaagatgcctgtcatgcagtatggacccccttctgtcccagtctgacgtggtttctgtttccttccccagaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagtaggcaacctactctctcgtcaccaccctgccagtccttttggagtctgttcttactgcttggcatctgggcatacattcttctctctcagaactacagaatttcaggatttagtgaggcttttaaaagagcttattgatcccctcctccaatgcaagaattaatatcagacaatccatgcagtcatccagcctggtctctgtgtcaaggcttccccagagcttgtccattgcatctctgggtaattctaatgacgaaaaagctggctcagctatagtgtgtatgtgttagaaagaaacaggatcctggcctaaatatgaacaaaatttgtgacatttggcattgttcaacttatttgagctcttcagtttggtctttagatcaaaccctctctaaagctctctcagctgtgatgacccagagttttctcaagagctaatctgtgcatccctgccactctactgatagggagttatggtggacagacacagagaaccattcagtttcttttactaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcatttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggctggagtgcagtagtgcaatctcagctcactgcaacctctgcctcctgactcaagcaattctcctacttcagcctcccaaggagctgagactacaggcatgcaccaccatgcccagctaatgtttgtatttttagtagagatggggtttcgccatgttggccaggctggtctcaaactcctgtcctcaagtgacccacctgcctcagcctcccaaagagctggtattacaggcatgaaccactgtgcccagccaacgtttggtttatatttttaagaactgtactaaacctatagatatgatctgtaaatggtggactcaggtttctgtatgtgtttgctgggcagtggctttgaagacagcctttgaggctatcaaagagatgaagcttgtattgctcaccaggttgggtatccattctatggcttccaagtgtgaagtcttctgggttaattctcaccactgtgttgattgtcaacagccaggaagcacttaccccaaggagtttggagatctgagactcatattttaagaatgaatgtcctaaccactttccaagtagcaaagaaagtgaaaacctcaccaaaagacgtgaggttgaatgaattaaaaaatcccagaggcggaaatttgcaacctgaattagacaaggaaggactcacttttaaagggcagtcacagcataaattgtgcttcacattattgatatttttagcttgtaattacacattgaaaaatccctgcgtcttaagggaagtgaaaagatctcaatggggagtatgttctgttactgtttctctcctttcttagacttatcctaatccaagaaagactgatacttataatcggagcacacatgtttctgtggctagaaaagactgatacattacacccctcaattaaaacaggaaatcaattttgacaaatgccaatttatatctatgccatttatctttcatgtctaggggtagggagcataattagagactggtgactgatgacatcagtttgtgggtctgaaagctcccaaaaagcagacttgagcaactaaaagggggaaaaaaattaaaacccccagataaccttccccactcgttcaatgcatgttaaaacataaattaaaaatgataataatgttgtcttcatgattggcaggtatgtagggagagaagttttttgatcctttctccatttcctaaaggaaaataagaaactgttttatggaactcttatttataagccttaaaattactagaatacaaagcagctaaaagtccagcataggctaatcactgaaagaccaaagagagggcagacaaagggatattcctcctccagacagtttttggggccttgtttgtggtccttttgaatgggtctccttttgtggacctttagaaaatgcatgttaattcagttcaactcacatttataaagaaccctctgtgtgccaattgttgcattaaatgctgaaggagagagatacaaggagagaaattgtgcagatatatatagagaagtcactgtcagcaaggagcttgccaggaggagggcagagaaagtgtgcagacagggagaaagggctgaactccatgagacaggcacaggtaagggcttgcactgtcaaagtcagatcacctggctctgtggtcagaataggctttgtggacggagaatgtcaagagtgttttaagtgggaaacaaggagattcctggcagagggaacaactcaggcaaaaagcagaggcacagagttagtaaagggttctctgtgttcagggagatttgctttgctgtaactagagcagcctgggagtagagattaccttgagatacaggagacccataagaagggatttacctcacctgcttagcctgccttttatttatttatttgtttattttatttatttattttgagatggagtctcactcttgtcacccaggctggaatgcagtggcacaatctcagctcactgcaacctctgcctcccatgttcaagcaattctcctgcctcagcctcccaagtagcttggattacgggcacccaccaccatgcctggctaatttttatatttttagtacagacaaggtttcaccatgttggccaggctggtcttgaactcttgacctcaggtgatccacccgcctaggcctcccaaagtgctgggattacaggcgtgagccactgcacccagccttagtctgcgttttaaaccagtgcttcccaaactttaatgtgcctgtaatccacagagggatcttgttaaactttggattttaattcaggtctggagtggggcctaagattctggatttctgtcaagctcccaggtgcccatggcctgcactttgtgtaacaaggttctggaatactgtttttgagaacttgttaatggaccatcctctacataaacacctttggtcaatgttgactcatatcctccagcctactggacatgcaatctttcacatatgtcatttcagatgaccgctgcaaccactgcagtcttctggaagactatctcccctaccctaacacacacgtacacattttctcatttcacctaaatggttatctttaaaggcccaactcaattaccgtttcctggaagaaaacttctctgatctccacccctcccttttctcaagtttagatttacatcttaatctctgtgttttatagagttttataagtctgctgtagatagcacttaccacagtctgactggtatagaaatatacatatgtgtgtgtgtgtatatacatatgtgtgtttgtgtatatatatatataactttacaataatcatcttgtatcatttttgcaataaggatttgtatatataaattaatagaaatactgcagaaatatatagaactccttctcaggtctgtactggaagtcgttgcttattcttgtattcccagtgagaaaacccagaaaagcagatttctttaactgactctttgcatgtatggaggctttattcccctatctgtgctttcttatcaggaatattaccctcattcatttatgtatttaatcagcatccattagttgattgccagaaatgtgccggaatacaagatgaccaagatcatccctctctgagccttcgctctgttggctgtaaagtagaaatgataaaaatacttcctcataatgttgctgtcagtagaaaattacgtcaagtgtgtacagcacttaacagggcttggcacataataagcactcaataaatggtagctttaatcatcgaaagttgttttcatcaaatttacttttacgattattgtccactcagtgagctaagccttgaaatagaccacctgggattgtgagccctcctcgaattgctatcggaggaacactgtggggactatgagaaccacctcctgcctcttcgctttggtttttctcattatggaaatgaggccaattggtaggaaagaatcattactcagcaagaatacagtttatgtcttcccaaagaggaagaaccttgagattgaacataaagcccaactaatatctttttttatacagaaatatggcagattcatttcattagatacagcccaactttttttttctgcaccagtcacagtggttgttcctggagactcagagatggagcaaagtcctatcttgtggaaacttagagtttagtgccccataaatatatccaaataattactaccaaaatggataaattcaatgacagaattcttatcttagaggagtaaataattctatttggggaaattggagaaggcttatggatacactgaaaaggaaaacatacttctgctcccacagagtttggggaaaggaaattttgcagttgatcccagaagcctacttatttcaccactgatgacccagatttaaaaataatctggtagtccaaagcaattttttgccactgaatataaacttcttgcataaaataccaattataacaactctgattactgctgcagtggtaccatgatccttctaacttttctttcacagcaatcaattgatctgctgcttaattcatatttatttagattgcagccatacagatgctttttgggtgctgccaggaaaattaattacctacatatagaatataatgtatgtagaaatgctttgacaaccgtaacgtgctctgcaaagagttagattattatcattatttctttttaagtctcactacaaatagataaatttttaacatcgtttatcttaaaaccagtaccatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagtattaaaagtatttaccagcagcctcaaaaacatatgcatatgcatatttatatgtatatgtatgtgtatgtgtgttagtatacactcaccctttaacagtgctaaaatcctttaaagaataaagaatttgatagctctttaacttttaatttttaagcaaaagtttaacacaataaaaaatgtaggaaatgcagacttggccacttttaagttttgtgtaatgtatatttaaacgcactaacctctgcccttttgaaaagctatgtatttgagtcttcttatgtcagttcctagaagtcaaggcaaatttccaagaaagaagctctaaaaggtgggaacaaggcaaagataccaacctcagactatttttctaggacctaaggagtgcatacaaaagtctagaaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccacctcttccttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagtgcctgtactcataggacttgggttttagatttgacactagtattccgagcacatgctgttgaataagtcactgtacctctctcagtctgcttgctcaccggaagaaaggactcaagtccttaactcctccaaatatggctgtgagagtgaaatacaaaattgtatattaaaggacattgtaaattgtgaaatactaaattagtgagaaatggtgttattgaacatttaactttggctctgaggctttggttagaacttcttgttcagagtcatggagatttatttatttgttagcatgcactactaattgctcagtttcctgaacgcctctagagctgcagtatatctgcatgttcttttcagtaaagccaaacttcccgcagagtataaccattgctgctattgtgttctggataccccgttaacttaaatttcattctatgtcaaatgaagacatgaactccattgacctccttgccaccatggtagatagcagaggcgaggttcatagctgttgtggcctttgagagtttatactaaagttagcaaacacacacctcttgatgaagtactatgtatttattttccaaagaaacttctattttctccaaagacaaaggccagcatttaactgttatataacacttttcaaaatggaccctaagaggagctgtcagcggtagtatattcctttacagttatgcagttctttgcatttttttttttgatccattatcttctttgatcctcttaacagcttggtaaggtagaaaaggcagaagttattttcagagtggcagtcggcctgtgtgcattgaggcagactgtagcaaaactgtgggtggtgctcaggaggcctgtcccctggactagcaatctttgctctccacaatgctgtctcctttagaaagtacagcaaaccactactccccacaaactttaggattttattttcttactgcagttgaagtaaatacaccgaacccactggtggcccttctgcttggcagacatcagtctacctttgctctaggccagaaatggccaaaacattccattcctgtacctgtgcatgcattttgagagatccttaaactaatggtaaagggtaaaaaatgcatcggtggttagggacattcttattttctcttgttgagtgggggcagcaaacttctacatgggagccaagatgggtggcctcttctcttcttatacctgtatttcatatcaagtgagcttaggaggattatatttatgtccatttatatttatgtccccaatctctaattcaattacattcaagatatactatgttatatattgggagaaaggatacaggggattagcagaatgtaaagcaggaaggatagtaagtggccacattatggaggccttgaatagaaagctcaatcatgatgttctccacatgtgtacttaacgtttttacttatgtcgtttccatctgtctttactgttctaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 2487 - DNA, 665269 bp, Homo sapiens
ggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtactcacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatgcctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcttggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatatgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgaggttgagtgaggtcacttttcacctctttgtcttctttgcttcctaggagttatgatgtccccactattcaaatttatgtcaaagatggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattattggttcccagtgcatatgaaatttatgtttacactatactgtagtctcttaagtgtgaaatagcattatgtctaaaaatacagtatacataccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtactggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtgacacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgctttttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggtaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatacttgtgtatgcaaagactttaacatttattaataattttttctatagattggtgaaattggtttgtaatttttgtcatttcacttttgtggaaattgagcaaaagtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctttctctttctttctttctctttctttctttctttttctttctttcttttctttttctctttctctctttcttttctttttctttcactctctctctctttctttcttctgtttcccctcccttccttcctcccttcccttcccttcccttcccttcccttcccttcccttcccttcccttcccttccctcccctcccctgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctttctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacatgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttatagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctgctgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgaagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttcgctcagactcaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctgtctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggatttttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgtcctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaagaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtagatgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatctttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaactttttttttctttgaaacggagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcaccccccaccctccaactctgtctctctctctctctctctctctctttctctctctctctctctctctctctctctgtctgtcctcctctcctgctgttgccatgtgaagtgcctgctcccttttgacttctgccacgttgggaagcttcctgagcctccacagaaggagatgctgctatgtttcctctatagcctgtagaactgtgagccaataattcaacaactcaaccacttcttttcttttctttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacccatttcttaatctctctaagagacatggactgtgttaaagtgtgtttatgaactggtggtcgagggtgcatttccctcctaagaaaactcattccttgttatgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttattctccattcccatgatttagccctctaacttcatgcatttctttttgccctttttcttgtgctggattttagcccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacacgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacccgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaatttgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagtgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaatttttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacagaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttatatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcggatcctctatttcctaattcatggcaacttctggagaacagtattttctctgttactgctttatggggtttagtgtggaaattaaagaagagaacttcttattttttgtaaataataatacaatattcagatactgttagtttctgaaatttaaaatgggcatctcacttctgtgttccctccccaaataaatgtattgatactaaaaaggaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttatttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagtggaggtgtaaaaactagtcttccagcctccagtcctgtctcagcattgctccccttcacgtcgttgtccagagctcctggtggagccttggccttttccatatgtacacgtgcacacacacacacatacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctctctctccaccccccaccccccacccccacccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggaggttattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttctctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagcgtcctgaccatctgtttctttctaccccaggcccattcccatcatgagtatttattctgcccagtgtgggatgggttctgttctagaagtttgcatgagcagagggaagcttagccccatgaggccagtcatgaggctccatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccgttaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccatttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagactttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcaacctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattctcagggagtttagagacaacataatgaaggtattttcaaggtttggggagctgcttggaacttgattttggacaaaatggaaggaaaacaaccatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttgtggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcacagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggtgtgcaccaccatgtccagctaatttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacccatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttctctcctcctcctcctccttctcccttctcccttctcctttctccttctcctcctccctcctctccttctccttcttctttttcttcttcttctttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccggagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacagaaagataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaattttttttttttagttattcttattttctaattattttatatgctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttcttttttttttctgttttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtcctttgtagggacatggatgaacctggaaaccatcattctcagcaaactatcgcaaggacagaaaaccaaagaccgcatgttcttactcacaggtgggaattgaacaatgagaatgcttggacacaggaaagggaacatcacacactggggcctgtcatggggttgggggacgggggagggatagcattaggagatatacctaatgtaaatgacgagttaatgggtgcagcaaaccaacatggcacatgtatacatatgtaacaaatctgcacgttgtgcacatgtaccccagaacttaaaatattaaaaaaaagaaaaaaaaaagaatttgcatctatttttagactttctgttctattcatctgtcacttcatgtgtcattattatgctttcaattattgtagctttataatatgttttattatctgacaaagattccccattcctattagtttctctttttcagaaaatttctggcttttaatgcctgtttatttttcattgacctttataatgaacctatctagttctggctgggcgtggtggctcacgcctgtaatcccagcacttcgggtggctgaggtgggcagatcacttgaggtcagaagttcaagaccagcctggccaacatggtgaaaccctatctactaagaatacaaaaattagccaagtgtggtggcgggcacctgtagtcccagctactcgggaggctgaggcaggagaatcgcttgaactgggaggtggaggttgcagtgagccaagatcccgccactgcactccagcctgggtgacagagtgagactccgtctcaaaaaaaaaaaaaaataaaataaaataatgtaaaaaagttctgttgatatacttatgaggtttgctgggtttatttgttagcattacatgctatacattgtaaaaatgttgattctttttcttggaatactaatgcctttccatttgttgaaaccttctttgatgttcccaggagcactgagatttttcttcatgtagaccgtgcctgtttctaataagttaattttgtagatattttctacttgctctagttaatgtaattattttctatttcatttaattatatgtgtgtgtgcctctgtgtttggggtctggatttcagtacattgattttctgctcagccactttactgaattgtctcattatttgaataattttagataaattttttttgagtttctagttaagtaagtatattatctgccaataatttatcctttctttccaatttttacaacacttatagctttcttctaactgtactaatacctctagaatagtaaatattaaataactgtggttgagtaaatgtccttcttttgtgtctgagtttaatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaacatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcttttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaaccatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggaggttgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctggggggaagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgtcaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaaaaaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagtgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttaggcatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgtttgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatagtcatcttccatcttcactttagaggtgggggaaaagggcattagagtgattgtgtggtaaaatccactctaattctagctgtgagaaaaagagcggtgaaaatgtggtaagcaattgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccattcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcatcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaaggccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttaaagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctaactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagtctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcgcaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgttttcccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgttttttttttttcctttggatatatgaccagcagtgggattgctggatcttacgatatttctttcttttttttttttttttttttgagacggagttttgctgtgtcaccaggctggagtgcagtggtgctatctggctcactgcaagctccgcctcctggcctcctgggttcaagcgtttctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtggttttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcctctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccattctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaagggaatggtttgagacataatggtcattgtgatttttcaagctataaaataaagcatgatgttaaaagatgattaatgttttcatttggtggtagatgacaagtttcttgcagggcatctgatcaatcatgctcttttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgcgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatatatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtaaacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacccacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctagtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccacgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttctcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcacgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgacaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacaatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcatgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcgaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgccttactctcactgccatactcctttggacatcctccttctcttgtttcctgatacttttacatccccttccatcctttactccttagcttttgtttttatttgcagtgttaaagatagcctctttttatttccctgtagtgattagatcgacgtgtttacaatatgaacacacacgttttctcttcttcaggctctgagtcatcgagttcacaatgccatgtctagtcagtacttctatgtgtgtatagtgcccattgtggccgagtagagataaggtcactgcggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttattttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctaggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttctattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaagaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgcttttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttctttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggctttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactctcacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcaatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagaggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttttttttttttttttttgagatggagacttgctcttgtcgcccaggctggagtgcagtggcgcgatctcaactcaccacaacctctgcttcctgggttcaaacgattctcctgcctcagcctcccaagcagctgggattgcaggtgtgcaccacgacacctggctaattatttttgtatatttagtagagacggggtttcgccatgttggccaggctggtcttgaactcctgacctcaagtgatccgcccgtcttggcttcccaaactgctgggattacagacgtgagccactatgccaggccagttgtgggaattttataagggctttttcttttctttttttttttctccctctggcctagtttgtggggagaggtatgtttccccaaagatgtggagttagcctgttgatgtaggcatgggagagtgagcttagacagagatgcctctcatataaggtagaaagccttccatgcccaacccaagtgttgtagaagttgaaaggggaaaaaactttttcaaaattggcttgacagcaaaactcctctcagtgtcttcttttttgtccccctctataaatggtaggttttcgtagtatcatgaccctttttagtaattataaattaatataagataaatttatggtattccttactatatagatttgttaaaataattcacgatatttcatatgtacacacaagctccttcaatccaattagtaagaaaaacacttcatgtcactgttaaataacatgaaaataaacaactggttaaaaaacaaaacccaaatacaaagcgttgagcttcctactggaatctgaatctgggagtgtcttgttgtaagaaatgttttcagacctatcattttcttttgtttctttttctttttttctaaacagactcttgtcagttctcttctgattagtgttcccctgggcttttcttcccaaaataaagttaagtgcattcaagtttctgggatcttctttacatccttttgaaaatgcagagtaaatattatgttggcttctttttgttttttttttttaaattttattattattatactttaagttttagggtacatgtgtacaacgtgcaggtttgttacatatgtatacatgtgctatgttagtgtgctgcacccattaactcgtcatttagcattaggtgtatctcctaatgctatccctcccacctcccctaaccccacaacaggccccggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaactcatcatttttatggctgcatagtattccatggtgtatatgtgtcacattttcttaatccagtctattgttgttggacatttgggttggttcgaagtctttgctattgtgaatagtgccgctataaacatacgtgtgcatgtgtctttatagcagcatgatttataatcctttgggtataaacccagtaatgggatggctgggtcaaatggtatttctagttctagatccctgaggaatcgccacactgacttccacaatggttgaactagttcacagtcccaccaaaagtgtaaaagtgttcctatttctccacatcttctccagcacctgttgtttcctgactttttaatgatcaccattctaactggtgtgagatggtatctcattgtggttttgatttgcatttctctgatggccagtgatgatgagccttttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagtttccccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcgtctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttggtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtgctgaaaaaaatgtgtattctgtcgatttggggtggagagttctgtagatgtctattaggtctgcttggtgcagagctgagttcaattcctgggtatccttgttaactttctgtcttgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgcctttttttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgagagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcggctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcattcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcaagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaaatagcatttacattttggctcttgaaataactaacagcatgtcatttccaaagagacgttaatcattgataccaccagcagcaaatgttctcattcatcagaccacatttgttttacacgttcctctccttagaaagagataagtatggtttcttttctttagttcttgctaataggatacccaacatattgaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtagtgtatgtatgtgcatgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaattcaaaaatcagtcaggcatggtggcacatgcctgtaatcccagttacttgggaggctgaggcaggagaatcgcttgaaccacgaagtcggaggttgcagtgagctgagattgcgtcactgcactccagcctgggcgacagagcgagactctgtctcaaaaaaaaaaaaaaaaaaaaaaaaaaaaaaaaaaaatttcagaagtcccggagtcctttccatgatgcatttgaagggccagagagatagaggcatgccctatgtagtacatcttgctgctgtccctcgtgtgtttaccctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcgcgcacacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtgcaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcgtgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggcagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacatttttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagtcttagtattttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaacagcctggttcatttttactgtgttgccattggttaatgcttaaccagattttgtctctgtttcaaaatcttgaaataaaagtggaacaacttccaacatgacttaagaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccgttaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataataatcaaggacttagaagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggttctctatgaccttttagctcttaagtagtctgtcctggctattgtcaaccatgtctttttttccttgactgatagaaactgtggcaaactaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacgggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagccaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgtttaaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctacgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgactgtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcgagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttgtatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttccttggagaagttagggaaatgttcacagagttagagacatttgagctgagacaatataaaaatatagggcttggtagaacgtgaagagagggaaacggcattgttgatggtgaacacagcatgagcaagggttcagaatcatgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctccggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggcctctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaacgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggtttttttttttgtttgtttgtttttttttttttttttttgagatggagtttcactcttgttgcccaggctggagtgcaatggcattatttcggctcactgcaacctccgcttcccgggttcaagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataactttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggcggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggacaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaattcgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattaaccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacatactttttgatggcattgtttgtttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaatgcttttctttatcaatgttgaatattggcccccattctcttctggcttgtagagtttctgcagagagatctgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgacctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaatcctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcattacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcatatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgcttgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgcgcctgtatacatcagatatatggattgatgcagtgtactctctctcccttaatatgtgtgtgtgtgtgtgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatgtattcttttgtagtgttgcttacgttttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcccaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatggtctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacaatctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcctggcagggttatcttacgctattgaacctcagtttctccatttatccaatagagatggaaagtattggcctgcatttatttctccttcaaatgacatattgtatagaagcgtatcgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaaaatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacgattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgatttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattacaccatagcagtccagcctgggcgacagagtgagactgcctcaaaaaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagacgatctctgtcagttttgcctaggacgttcagtgggacttgggtaggagactgtggactaatctcacctctggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttactgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcacagaagcctaacgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgtgagttagatttgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcacatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagacagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgaatacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcacacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgtttatggaaaaggagattaaagaatgcagtgtgggttttttttcgtggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctgtgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaaggtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacacttcctttcacgtttgtaaactagttatagatttggtacatgtagtcagtcactgtgctaaattctccttaagaattacgtctcttttttgaaaaactaacttttaaaatagacattattattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatgcatgtgtgtgtgtgtgtgtgtgtgtgtgtgtgtgtgtgtgtgtgtgtgttacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccatttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttgcaagagtccaatgctgcataatattaataaacttaattttcttaaattttcttctctggcagagaccataagcagtatgatatttagtcatgctaggataagacctgagtagaaattgtactagctatccagctcgtttgttaatttacttttgatgaggcagagaacggtcatttaaccagcttttgttcagtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaatattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgatgagtgggttgggattaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatatgctgtgtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtacgatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaacaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtaaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacattctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatataggtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacgctccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacatacaggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatgcagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcaaactgcctggcatggtgcgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaggctactcctccataaatagaaaagatctcttctccaacacatcaaaaacattatttttaataggaaaataacaaataaagaacaggttaaaaggtagaagtttctgtttccccaatacagttttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttataagccatcctagggagctcatgaatttcatgagtgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaatggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccgtggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcagcagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggtaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattgatctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcatttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttgggatatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacgcggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtgctcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatcgttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctttggcttttccacattaaatttctcctcttggtttatttttcagagtactctatgacctacctcatcctatgtagcacactgtatctcccactgtcctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcaatctcggctcactgcaagctccgcctcccgggttcacgccattctcctgcctcagcctcccaagtagctgggactacaggcgcccaccaccacacctggctaattttttgtatttttagtagagacggggtttcactgtgttagtcaggatggtcttgatctcctggcctcgtggtccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccccagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgtttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctccttcctttccctcccttccctcccttccttccctccctgccttcctccctcccctctctccctccctccctcccttgtccctcttgcctgaacttcatatcagtgtgtcttgaatatttgaaaaatatttataggaaagtgaatgaaacctatcctaaatggagaagtagatggcaaaaaagggtattagagcttggcttttcaattgtaattgtagccatgacctaatttttggtaatctaataggcccatataatctctgcttggtgttagaagggaagacctttcaccttttgtgttttcttcctaatgtcatgcaaagtgctagagctttggagcaaaatgtttgatttccaaattccaattcttccatttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtttcaatgagccaaggttgcagtgagtgccattgcgctctagtctgggcaacaagagcaaaacccggtctataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggtgttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgctttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgaggctctcatcagaaactgtctggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctctttccataaaatgatatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacatggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagaaggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacagttgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagaaatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccgtccgtccttccttccttccttccttccttccttccttccttccttccttccttcctctctctctcttctttctttctctttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaggtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttggagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatctgaaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggttgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcactgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtgcagagaggtttcaggttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttgtgtgaacctgtccatgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccaagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgcgcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacagtagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaagaaaacagaggactattatgttactatttcctaaataaagaccaatatgataaattccttatattcagtgagaggaaagaagttgcttaccgaatgtactgatatatgcttccttttttcagaaaacaacaacatcaaccaaaacacctgtataattattacatgaatttttttttttttttttttttttgatatggagtttcagtcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatgtcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgggccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttaaaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtaggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaatattggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttatggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacacacacagacacacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttaattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatatgtgtgtgtgtgtgtgtgtgtgtgtggtatattatctatttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgtgtttttttttgttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaataactaccataatttaaaaatgcaaatgtagcaatgcactaaaaaatacctttagcttattttttgttaagaaacaagtgttttgcataatcagactttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctcctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaacggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggctttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagaacccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaacatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagacacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcgtaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgtaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggtcgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtggttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcacagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaataacaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaaattaaaaactattacattttttctccctcccttcctttctactgtttccctcctctcctctctttggtttccttccttcctttgttccttcgttccttcgttccttccttccttccttctgtccttcccttccctccctccctccttcctcccctcccctccccttccttcttctttcttgccctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcacttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgcttttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactctcattgggggttgggggggttgggggtgggctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctacttgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaactaggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgtaatatgtgacagttccctgggagtttctcccctcctcgtaggtatttttagcaaaatagtccttaaacattgttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcgtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataatttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttattgagtttcttccctaatttagatctcaagttttgcaaaagaatgacaaattcctttatttaaagaaaaatgaaagcagatctgttaccttctgtcctatgaatgccaattctctatcctggataattagataaataagatatgtataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttacaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgattttctgtccttttatatttcctccttccctctgagggttcacataggagcctccacagccagaggattactttcagaattggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaacgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcattttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcactggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaattccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatatacacacacatatacatatacacacacacacatatatatagcattcttaatctcatatatatataatatatatataatatatatatattatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggtttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcaagttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctcttggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcattttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtctttgaattaaagcaacagggcacaatttcaggagccattgctttcttctaggaaatacctcactattagagctctctttggagatgagaagatttttctcaactttattatgaattccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttggtctgtatatcttgtttttcatgccagtaccatactgttttgattactgtagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatatcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctaccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcaccatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcaataccagtaccatgttgttttggttactgtagccttgtagtatagtttgaagtcaggtagcatgatgcctccagctttgttctttttgcttgggattgccttgtctgtacaggctctttttcatttctatgggttttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaaaaaaagagagagctaacatcttcactttttaaggaaatagacattgcccccatgattgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatactttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcgaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttccctttccctttccctttccctttcccttcccttcccttctccttctccttctccttccttccttttccttccttccttccttccttccttccttctctctctttctctcttctttggtgtgctgagaataatctgcagacagtgactctacagataagattgcaaatattttcccttccttcattccttccttctttcctcccttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaataaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagaaaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcattgtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatagtcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagaccccatgttgaagaataagatacatatgctgatgtctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaacctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccatttctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggattgccattaaaataattttgtgcagcagcactgtgaggactcagaatccagaagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcaggtgcggtggctcacacttgtaatcccagcactttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgtaggagtcaggttgcctataaaggcaaggatgtgcatacagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacaatctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggtttttttttattattatataaagccttgcagtgagtcatagaagaaatgcactggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaaaggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataattcataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagatcctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccatttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagtcgtcttgagacaataggttgaagctttcactacatgttcttttagcaaaaaattataaagcatagaggttgagatgggctctggaatcagactacaaagattctgatcttactgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatctctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacacaccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgttaaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcagctcttaccagtgacttcagtgcttccttatacaaggtgcaagcggtgctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggcattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcagatatgtgtcatcttaatattcctattaaccttagaactttgtgactgtgttgggattacttgacatatttgtttatcaatcaacacagtgacagtgacaacgaatgagtaaccagtgttttgtttttgaaacatttgaagaagtgttccatatttctgaagttattagtttagtttaggttagtttagtttagtttagttttaacgacagagtcttgctctgttgcccaggctggagtgcaacagcgtgatctcagctcactgcaacctctgcctcccaggttcaagcaattctccctgcctcagcctcccaagtagctgggattacaggcacctgccaccacacctagctaattttttgtatttttagtagagatagagtttcggcatattggccaggctggtctcaaactcctgacctcaggtggtctgcctgccttggcctcctaactgaagttattttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtagcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacatcatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttgaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactcttggtgttgtacatgttgtgggctttgatgagtgtgtagcatttatttcccgtcatagaatcatgcggaatactttcactgcccctaagaattatccttgctctgcctattattactttctcccccaaccccggtaacccctgaaatttttactggcttcatagttttgccttatcagaatgtcttatagttgggaccctacaatatgcagcctttccatattgccattttactgaataatatacattcaaggttcatccatgtcttctcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttttgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaagattgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggattggggacacctgttacagaatttatactgttaaatgtcacttgatatgcacactaaacctattacaaaccacatattgtcacttgtcataattggacagagctgcaatgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccttcttcttcttcttcttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttggtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggaacagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccagcatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaagcaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacattatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgatgtgaaaacttagcttgtccagccaaactggaggaaggagaggcgggacttattggagtaactgaaaagagaaaaattggaatatgagcagtaccaatactcagtctcttaaggaagggtagagtccctttctttctgtctctgtaatttttttcttttttgtttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcaattggttttgttaacactgctgcaccgaagctctagctgaattcacataatctcatgattttagtaaaggtaacaaaggaaaacgattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctcccacagcattagccttagttatgagtataatacaaaagaagaggaccagccctgctggaaggtaaatgaaaagatggaggaattgaacgattacataacagctgttcagacttgtggtactgattagagtcatttgtagagatgaagcagtgtgtcaagccagtgtgggctagggtatactgggaagttctcacagacagaatgaagtgggttgcggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgtgtgtgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaaatatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattaatcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccgtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatggcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttccctttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcatcttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtaacaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatacgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaatactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcagacatatggagtttcaaactaacactgtggtaattgttgtgtgtctaaacaagtgacaacggggctgggcagcaaaactagacatgggagaagccaactgatccattgagctgtcccagcaagagttagtgggattatgatttatgaaagacctgtgtggacaaggtagtttggaggaactgaatggagggagtgaattaattagaagaatgagacaggactagccacaaacttctcctagaagtttaaactattttaaaaataagagttgtggctcatcaaaaaagtagtgttttcaaaaaacacagccccttcacttaaatgatacgcacagtccagatagactgcaaaacttaatgtttagaagctaacaactttttaaaaactttattgatctgatctgtactgagaacagattttctctgtgctttataataaaacataaagatcaatcacaaaataatttatcaataaattttaaaacaaaaattttaaagtgtatgtaaatatcatataaaattaagaaaaaatatgtaagaataatatttgcaatgactatgataagcaaagggttaacaactgtatgaaaattttcatgcaaatacaaatatcccaacagagaaagacaaggaatgtaaataattcttaagtagataaatacaaatggatatttaacttaaaaaaaattttattcacattagtatgaaaagaaaatttaaataattgaaatctagtttttcacttatgaaattagcaaagatttaggaaaagaaactactgtcatttgctgctggtaagaccgtaaattggcccaaaacttttagaaagttattttacaatatttctcaagaactttaaatgtctcatatctgtcaatccagacagatagatggatggatggatggatggataaatatcagatggatggatggatggatggatggatttatcagtaatagatacatagatggatagatagatagatacatagacatctatagagatatatgtttctatataaatatatatctatattatcctaaagaaatatatatttgaacaaaatctatttatgaaaatgttcactaatgcaaaacttataatggcaaatagaaagggaatctgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtacttcccaataatcagattacatgtgattttattttcccccctaattttccttaattttcaagttccgtacaatgaacatgtgttattttcataagtataaaagacttttttataaaaagaaatatatagaactaattagccaaataggaaagtttctaagaacaagggaagaaatttgtgaatggagtggtgaagagatccttggactgagagctgggcaatgtggatactaacactggctctgtcacaaagaaacaaggagacttattgaggttctctcttctggctcaaagattttatgagccagtaatttatcaaagagcccatcctagtgtacccatgggcctgtcaaccctggtagacaggttagtagcccagatgaaatttcccgtggatgaattttagaactccgctccattgatcacccttttttgttgttgttgttcttttactcttctggaagagagctaagaaacttctgataccatccccctttcccactcgccctcagttgtgagatggaggcagcaaatattcagtgtgttctttttggtcttaagtagttctagactcagataccacctcagcaccaggctgagtttgggctggctttggctacggtttgctgctgaatgtatcagtgatggacttttgaatgtttaatagccttagggaatgtggcagtgtcccctacatagagaactgtagattctttagtccaccatttccaaccctgtgatttagattgtcattataagcatcacaggatgccctgagttgagaaaaatctgtgctgtttaaatggtctttaagcagcctttcctttctcctctttctcagctctattctgcttaggatatggcttatgccacttaatcaacatgctatcatatgctttctgcattccagacatatattgaaatatcttggttgttatagccatcttctcccacatacatcccctttctctcttcccctctacatttttttctgttacttgttatttttggtactgatgtgcttttatttgagtaggatattggaatgcaattgtcttcttagtccaccatcccctgacctgtcattattgaaaaacaaaattctgtagcaaatgagtccccgaaagtgttttttttcaaatgatgatgatcggtcacgttgtgaatctgtagactcctttgcgaaaacaacaataaacacagtattatttatggtggatatgctaggtacatccaaagctcttcatatgtgttgccttgtataatttcctcagcaactctaatttaatagaaactattgtccatgtatagatgaggtagtttatacccagataggttatacaaacctgtaagtaacagagccaaattttaaaggcagacaatgtaactgcagaaaccttgttcctaattgtttaatggaatatggtttagaattctgtgtggagaatcttactctaccctagtggtaaacttaaagctctttaatttactgtggttatattatatatgtgcaatggatccctattttcaaacatagtcgtttgataaagtgtgggctgcttttcatcacgaatgtaaaaagtctcttagttgctacacccagcaactaagtgtcctttaattcttaactttgaatacttaattggatccctggtgctatgtgtatttgatttttgttgtgaaagttgcattcactgtgtccctttatttgacatcagcaagatgtaatttctataaaccaattaatgatgcacctttcaactcttactatgagaatattagctggtgtaaatatcggactccttgtgaaggatgactcgctatctgattggtctttaaaaaaatactttaggaaataatggcttgcccctgcatataccaatttgaagtctttctaatatcagccattagctgggatccacatggagtacatagacaaatgaccatagtttctactgtaaaaatgcctcaagatcttgtaggtgagattaggcaattagataaatgcctatagcacaaaatgaattaacatgattgcttgaaaagaattaatttctgtaataatttgaagaaggaagaagttatgtatgctttggggggtatacagaaaggctttataaacaaccctatgaaaaaatggaccacagttttaaacgggcaatccacagaagggaaacactgcaatattcattggaaaaagaaaaggaaggaagggagtgaccaagagaagaaacaagaaggaaaggactgaaatcttgtttgcctttttggagaagatagcatttgaaatgggccttggataataaggtgtgattgtcgttggtggaaatgaattgcatccagaatgcagaaataactcaagcaaaggcatagagattggaaaacatggggcaggtagaaaacaagtccagagtctttgctgcttcttagaagatgtataagggttttattttatagttttataatgaagggcttttaatttcaagtgatgggtcagtgtataattccttaggagataaaattccagggaaaaggaggaggggttataagataaatctagaaatctaactcataaaaattagttcccttccagggagttagttactccaaaaatatccttgataagctaactctgcatggatataactgtgttatctgtgagctggctacagacaagaatttacaattgtctgtagttgcagtctttgagctgcagtcattcaatctctgtctactgctaaaagccagagtttggaaagagcccttatgcatgcttgataatgacacaatttgactgagaatactgccattttataataatctctgaaagttacttccttggtctactgaatctcatattttgtgaagttaaatgaccaatgactgtcattcattggccatgattgtcttgagtttgttgatactaaggtgttatttataatgtgccttttgtttctcaagaatatgttcgcagaaatcaccagtagtgttatccatgtgtatggaaggccagactgtatccccttatgtactaacagactgtatggcaagaagggagccaggttgtcaatgtgagagctaatgttgatatcaacacaggcatcagaaagtcaattactctgtttccctagtttactaaatggtgcttttgcaatagggaccatgttgcctaatgggctgtgaactttaatttgttcataacagtgccaatgagtaaatggatctacctgtggactttagagtgtacttctaacattttaggactgcaagaaagtagtgtgttttatcctctgatacattcatattctctattggagcatacctatccaagcccaatatcctacatcagttttaataaagagaaattacatttaattgtgtctctatcctttcatattaatccattatgaatattttattccacaatgttagaaaaattacattaacttattagtgaagaacattcttttataagaagtgctttatacttcagaacctcataacttactttaaatatttcaggcacaataactggtaagagatgaaaaataagcctgaactcatagggtaaggaccatttagaagtcttttgtcttcagcttgtgattgttcagttaaacttatttgatgtgtgctcagcaggttgtaaaattcctatctttctggagtgatccataagagattacttcatagtgaaacacttaagtttgattcttatgagttgcaaaatgattttccaccaggaaaaataaagaatatgggttccatcaaaagtcaggcatgaattctcatctcctgataaaatgtgaaatatctttgctgatcctgtgcctattctcagtttccatgaccatgcacaattattatttttagcaaataagcaaatttgaggcaaaaacattaatttgataagatatctgcaaatgcctttctggaggagaaaataaatttaaaaagcatcagtgtgtttcactgatatgcacaatcccccacttcttataagaaattaaaacactagtttttaatatcttcagagagaaaatgagtaaaggaagcacagtattttccgaaacgtgttatttaaactaaaaccatgaaatttatgaaaaaaaaaaaaagtagacccttccttgatacacttggtcccaccgaggttcaaagtttcctttgaattggggggggaagggagattctgtaatttaagttttaaacttctgtctttgtatctatccttgtgctggtactccgctatcttggttgctatggttttagagcaaatcttcatatcaggtggtctaagttctccaactttgttcctcttttccaaaattagttgaactattgtgcatcctttatatttccatatatattttagatgtggcttgtcaatttataccaataaaggattctgttgtacatgtaaaccaaattagggagaactgacactttaacaatattgtctttcaatgcatgaacatggtatatctctccctttacttcatttttttttttttggttctctcagcagtgtttttaattattattgtaaaggccttgcacatattatggaacaaacacatattatggaacaaataaatgtaaaagctaaatctataaaacttttccaagaaaagaaaagaattcttacaaccttagataggcaaatatttcttaaggagtatacaaaaaaccccacaaaccataaagttaaaaatgataaatttgattttataaaaactctaaaacttgttttttaaaagacaccataacaaatgaaatagcaagtcccatacagggagaaaatatgtgtacagtatgtgtatatgacaaagattttatgccagaatatagaaataattattaaaactcaagaagaagacaaagaatgcaatttaaaaacaggcaacagatttgaaaataggcaatagatttgaacaggtacttctctaagaaaatacacaaataaccaataagcaaatgaaaaatgctcaatatatgtagtcattaaagaaacaaaataaaactctgtaaggtacctccatacattgatgagagtggctaagactaacaataccaagcattagctaaaagacagagcaattgaaattctcatacactgcagttgaggatgtaacatggtactgccactttggaaaacagtttggtagtgtcttaaaaataaaacgtgttcaacatatgacccagcaattctcctccttgacattgacccaagtgaaatgaaaccttttttttacacaaaggcttgtacacaaatgttcatagcaactatatttataatggccaaaaactggaaacaacccaaatgttcattaacaggtgaaaggacaaattatgctatatttatacaatgaaagatgactcatcggtaataaataaatgatctgctaatatgcacaaatacatgaaaaaaatcttaaaaatatgatgctgaataaaaggaaccagagctacctccacccctaaaaaagactgcctaccttagaattatatatttacaaaatcctggaaaagacaaaactaatctatactgacacaaagcaatcagtggtttgctgaggctgggagtggggaaaggattgattataatggggactgacaaatagggaactttttggggtgatggaaatgttccagatcctggtaatggaggcagttacaaagtcttataaatgtattgaaattcatcaaagtgtacagttaaaatggttttatttattgcatttagattatacctcaacaaaggtggttttaataaataaacaagaaaaagtgtttttcaccaattggtttgaaattcggccaaggcatatttgagcgagggctgtcagccttgtatttgttgcaagtcacagtgagtatgtcctaatggatcctctacaaggtccaggttaggtttctttaaaggatggcaagaacctgaaacagtgtgagtgcagagaacagtgaaacagtgtgtgtacatagtgctttgatttttgtgcattttttggtcctaatattttaaagtttgctgaaccatacctcatagaacatttacctgctttttctgagggaaatatctttatagaacttttccaaagcattctgcatagattttattttaagaaattaaaacattttatttgtattaatttacataataattggttaactcacataattacaatgacaagatcatacagtaggagcagacttgggatcaaatgcagctgactctaatagcaggtgtagcaggaggcacacagctgaggggacatttgagacgaaattgaggccaggttccacttcacattgtactagggttaagcgtgtccacccagaggaagagaatccttaggcctaaaagagcaaaagtgtacagacatactcaagagtaagagagtagccaggaacaccagccaagccataaactccagtctgtgtgtgttaacagataaaattaagagggtaatctagggagtctattgctaaatgaagggcacattaagtctcaacagtattcctatgatcaatcaagcaaccaatgaagtgtacaagcagaagtgatttgtcatggaatttcagagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtggtaagaggccagttttcccatcctcatttactctaaatttgattcatagattattgagcctcagatatctgtttgccatctggtctggtcagtctggtttggcatgcgtcttctttctctttagagtttgatgacgttttaggctgtgaggggcatttgcattgtagtagaaattggatgatgtcagacttgctttatcacactttctcaataatctcttttggtgagtttgatattctacttacagctgctaaagctccttataaccatacgcacaaacatacacttccatatagtcatacatactcacaaacatatatacacagccatttacttacacacgtgtacacaaaggtgtatatccacacacttacatgcacaatgagagatgcatagtaagaatttttccactacccctagtttaactggaagctgtagaaaatctgaactttattatattgatctctgggatcatccacaaaattgcccaaaatgggaatgcggaagctgtttcttacctttcattttctccacatccaatgtgtcctcttcaactgtgtattttgaaacaacctttgaatctgtccccttcccgcaactgcactgccaactgctgatatcattttttgcaaacaagtgtaatgaaaagagcatattctttaacatcaagcaaactaaggtgcaaattttagctctgcatgtattcattgtgctatcttggacaagttatttaactatcctgagcctccttgtcttaatgtgcagatagaagaagataatgcctacctgataggtggcataggaaaaggtcaaaaacattattttctactcccattgctccccttgcctgaaacattataatggccaaacaactggcctcccaacctcctttcccctcttcagtttttcctctacattatagctagagattttgctaaaatgtatatatggtcatcccattttttacttgaaactggtatcttcctgcctataaaacacattttgtttcttagtctcacataggaaatcctttttagtctgtcttgggcccaggactccagtccgattttcctcccattcctacctgccctcttggttttgaatgttccacacaacttcattcctttctctgttaattggcttttcctttacttagaatgctttcccccttcctgctttttagggagaacagggtaaactgttctccctatccttcattgagtctcctttcttttttctaaagttttttcttatcagcatccctcccccaatttgagctcattttctagaaagaattaatagctttcttatatgactctcaagatatttctgtgtggttctctaacagccttcatttattttatatggtaattatagatgtccatttgttctagggaaggcaggtgtcaggtcttactcatctttatattcctggtttgacatacagtgcctgatgtctagtaagcacttgatatctgtttattttaatgtttatgccctacattatctatcacaagtattaaagattgataggtgctctgtaaatgttaaattgagttaattattttcaatcttacaggaagttacataagtcattcctgtattcatttgtgaattttcgacatcctatattaagagttgcacttagaatgtgagttccatgagggcaacagcacttctgtcttactgctctgtctgctatgttggcccataattaaccactcagtaagccttttgtgaaaacaacctcaatgagtcttctacctcaagtcttttgaataggaatggatttaaagctgacccctaatacatctttcaaactttaagtcagtaaattttttacaaacttttttaagttgataaatccctcagaaattattctgaggaagctgatgggatagaaatgaaacagactaaggggctccaggcaatcaccactccccttcgttctccttcctctgttggtggggatcaatagagcaggatcctcaaaactgtggagttctttggagcatactttgaaagcctctaattctattccacgctctaatttccaaaagagggaactgaggcccgtggtggttaaatgccctttccgaggttacacagctatacatggtagagccgacccatgtcttctgactctcatcccgttgcacttacaactagcctgcatgttccccttttcccatatcgcatggatagcatcttacgcatctaagtttttttctttaataatgatcttctcttttctttaagagacaccatcactccgagttgtaccacttgcaccaggctaaattattcctcagtgtttacccctttcagatatttatagaccatcattatggcactccctagtcacctgtcagcttcctaatatgtacatatatggtttctttaatctttctgtacagtcggcttctctagtcccttaatcatttgtaccattctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgtaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaagaaaccgttactgagcgtatccatttttatgcagtttctgtggacttacatggtttctgggagctccctataagccttagtaagggaaagctcttgacttatctcactagttattagggatttggatatatgtttactaaatgtgataatctaagtatggaaactacattagtacaagaggaatcacccagaaatactctactggcataaataaaacattacctattgcccagttttctcatttgtttcattttgtaacttttataatgtgtcaataagtttgaagtcttgaagggctgcccagaaaccaccacagagtggattttccttaccctcaatctgccttcatcaaaatttagtttgtgtgtttatcctataaaatttatctcataataaaaactgaagactaggacggtccttagaaaaacacttgattcggtgtatttattttataaaagggagtcacagagagaaaatgtggccagctcaggtacatggcttcctaggcaatgttccatttcgcaaaactttcattggtccagaaagtgtaccttcattcccaaccaaatccttcctataatgctttccatgcctttcttctgtggctctctctgatgatctcacaggtctataagctcttacaggtagaaatatgatttcttgctgtgttcttattataaagcattgccatgcaactgagaagtaatgagagccagtggattttattagaatggaattttaacttttctactttaaaacccagtgattctgctagtctggaggtagcaaagaaggatgactattttctctctcacacaaagtaagattctgaaggggcttattctctgaatgaaaaacgagaggagaaaagtaagaaccttctaatgttttattcaaatgttaacaaagaaatttgagaagcatgtttccttaaaattgacaccatttttatcccaaacattctggtaagtgatagcagatgactgtgcaagcttctatggagagagagagaggaatttttccaggagcatagtcccagtgggaagtattacctaaaagtaatacactaatcactttcaatcttgcatatttccacatactgtgtgcacacatatgtgtattaataactgttccctagacgtcacttcagcgctcagacagcttagtgttgctatgcgaatgctggagatggaatcagatgcagactacagtttagcaatgagaattcttcagagatacaagaatggaaatggccttaggtcctgcctcatgggtctccctctgagctccagtgtaacatcgggtgtcaagtatttgtggccccatctgcccactccactgagaatctaaatggcattgccagtatttgtgaggtactcatatcttaaaagtcagtgtactcaaatcagtcttgcattctaccttgtggattttgcatggaaattttttagaatgtcattgctgatggaagccccagatatataagtacatctgctccatcgtactggtgatttttatagatattcataagaaaatttattttacagcagtttattttagaggaattctttgcattttatttgtatgtgtgtatacttattttactggcaggatacacacacatgtatatacacacacacacatacatatatacacatacatacatatatatatgaatgtatgtttgtatcctgtcagtaatactttgaggtacctagggctgagattactatttctcttccacctatggctcaaatgggtaaaatagcttactcaaagtcacagttcatacatgtggtgcagcttgaatcaaaactcaattcttctatccacagatttaccactacttgagtagtctgtggtgtttaaaaaaaataataaacaacaggccgggcacagcggctcacacctgtaatcccagcactttgggaggctgaggcaggtggatcacaaggtcaggagtttgagatcagcctggctaacatagtgaaaccccgtttctactaaaaatacaaaaaattagctgggcatggtgacgtgcgcctgtaatcccagctactcgggaggctgaggcaggagaatcacttgaacccgggaggcagaggttgctgtgagccaagattgtgccgttgcactccagcttgggcaacaagagcaaaactctgtctcaaagtaataataataataagacgaagaagtaacaaagccaaactggaaagtttctgttaaatgaatgttctagataataccaacgtataaagcaatcattttataccagctatggtcaaacagggaccagagccttgacttttttttgcctcaacacagctctgcagaacccactcagtaccccatgtcctactgccattcctttggtttccagaacattgagatgtacaaatccaaaacaccacagtgtttcagagagaaatggcatgactctactggttgcaattgtaatggagttcaccttgttctggagtcatacagaagccatgttgtagacttagtgtcccacgcaatactcctaattacaatgaaaatctactgttaggtagaaggagaaattcctcacaatcaggcaacagcgcctactagtgggaagaaactgatacttgaggtagggcacctgggagatagctctgtgcatcttgagagagtgctacactgagagcccaaaggctctcaggtctcatctctcctgacagcttgctatgacatcttaatcaatgaattgcctctctcttaccctttgttatagagtctgtaaatgaagagtttggaatggctactttctaaattttctacacgtcctatgacccttgaaatcctcttaacaatgtattatggatactttgctactaaacggtaaaacagaatcccgagtaagatgaattggcttcctaaggaagtagtgtcaggggagaatagcaccatctttggggccagttccatttatgcaggtaatatggtatggtccagctcaaagatcactggactgggctgagttgcaactctgctacctacttctcaagtcatgtacaaggtcattcctatgttaactcatgtgttgggaagatgataattgtctcatttagcttttagttattataagattcatatgagaatatagaaattatgaagttttatgtgaatctgcaaatttattttcagtctttatatatcacaattttaatttaggctaattataatttttattttcccctttttgttctatattctaaattcgtatctcccatggaggcaggtactgtatggacaaaatcttttattagtcacatattgttttcatccattttgtgctgctatagcagaataactgagactgggtaatttataaagaatgaaaatttattttatcacggttctagaggctggtaagtccaagatcaaggcaccagcaggcttggttttctggtgagggctactctctgtttccaggatggtgctttgtgctacctcctcacatggcagacagtggaagagcaagccagcagaatgccgcatgaagcctctttcacaaagggctttatcccattcatgacagagaagcccgtatggcctgatcaacactttttaataaaatcacaatatctactgctgaattttggagggaaccaattcaaatcatagcacacatcttttctaaaatggaaagggtaatatgatcattggagaaatactcattcctttgcatattggtttactatccaagccaggtgtggtggttcacacttgtaattccagcactttgggaggccgagatgggtggatcacctgatgtcaggagtttgagactagcctggccaacatggtgaaaccccatctctactacaaatatcaaaaaattagccagccatggtggcacacacctgtaatcccagctactcaggaggctggggccagagaattgcttgaacctgggaggcagaggttgcagtgagccaagatcgcaccactgcactccaacctgggcaaccgagtgagactccatctcaaaaaataaaaaaaaaagtttactatccagagaatcttgtccaggttaacactcttttttgtctgctttcttcttttgtgaaacaagaaggtaagagggacactggagaaaacctaatgttctttacaaaatgagtcatagttctccatctgcaaactgtggctcccatttatgtcttggtgtcaatatgactattacatgttatgtacatggattccacctcatttgcaacatagtcttctgcctgagctctgtttgttggatctgatctaactttacatggtcttaagtcacacattgaactcttaagttctgtaggcctctaagcctttttaagttttagtattttcatcgttaaaatgagagtgattataacccttgctttgctgcctccaaatattattgagggatcaaatgcattgataaataagataaagcactagacaaatataagggatgcttgatgacttcacagagggaagattattctgttgctggctgctgaaatacagtagctttagaaaaacccctttgggttcccttattatcaggtttggtctcaaataaccagaataaatttggagatttcctaccacaaaagctaaaagtacctgggcagatttaccctttgagtggacctaagggaaatgcagattcccacgggagagatcacggagcagattcaaaccataaggcaaaaataattgttgcaatagcggttctaactgtactagtaaatattgatttttctgttagcagatcaatcatgaaatgaattctaaatatagaagactggttaaaaaattaagacggagaatgtgaaaatgtccatgtgtaaaaattaacttaaagagaaatcttgctttggccaaaagaaatactactgtttctgtcaggaatgttctgtgatttaatcaagtttcctgcctggccagataattttaggaattgtggacttttaaagtagtaagtcagtttagaaaactggttaagtggacagatgtaaagtcagactgcctaagccccaattccagcttcaatatttaactctgtggttgtgggcaaggcacataatctctttatgctgccttttcatcaactgttatggagataatgatagaacctacatcatagagttgttggggtgactacatgagataatacaattaaatacttaacacctggtccataaaaagcgctgaataaatattgactattatcatcaccccggggtctacaaatttttgtaggattaggattaggattgaaatttctaccgaaaaattccatcagtaaaatattgataaatataaatcttaaccaactgcctcagagacatagggacctctattttccactcattgactgtcatctttagagaacagtccaaagcatgtgcctttctgttctagttgttatgagctctttattttgaagttgaactatatacttcctatagtttaaaggagaaagaagtaggtctcatgctggacaccttctagatgttacctcctccgaatttcatagccaagtatttaaggcagttatgatcatctccctcttagagaagcctagaaaaggttactgcagtgcttgacagcaaatagaaactcaccaagtgcatttgttgagggattgacagaatggctggataagtgactcaactaagaccacttatctagtgagtgcgtctactcagctgcttgttttgaagacaaggaaattcgggctcagaaaatttaggaaacttgtctaggctgccaatagctagtaacaaaggcaagaattgcatatctgattttctttacaccatgttacatctaactgttcaaaagataaccatgtattatactcgaaaatgcaaaacagggttgttttttgttttgtttgttgtggtggtggtgatggtatttttgttttgtttttgctacttttcctgagagtggaagttgttatcaaaaagttactgtcatgactactatgtgtatagatgctattagtttcatcaaggttgggaatagggtatatgttgcccaactttctgcccctctccgcctcatattaaagttccagtttcctagaatatatctcctgggagatttggcactagccatcactgcattccaataccccgggacaaactactcttggtggaacacagaagcatacagtccttgttacagcagtggttctcaaactcacattcctgatggaaagctagagttgaagggtcaacacccaagagctgcagtggaggaccatcacctgtcctgattcgccacctgtggtagatcatgactttcactaagatcccctgaggcttgtggggatggagaagtgatgctggactggcccttcctctttccctgcaggtgttaatgggttctgctcctaaacaatactgatataggtcagagttatgattgaattgtatacatagaaacatgtgctgattgagaaaatgggctttacaagtcagacctggttccagtctcagccacactacattctgcctttgagactttggccaggtgatggaacatcaggtttcttatctaaaaaggagaataattggttggtaggactaaatgaaaaaatgtatgtgaaatgcttaggacagtgctgagcacagataaaaatgcacaataattttctattttttgttagtttccttcacaatacatatatttacatcagcgaaacatgcttgcttttgcaaccttctgtgggactccccctcctaatttaccacctcacctgaaggtctaagctaagcaaatctctgtctataaatgaatcacatcgtggttagactttataacaacttccccttgccaggagatcactcagccttcacttcatctcatctggtttgctgcccaggcctttatccactcattcctgaactcctctccctgacaaccttggggttttggcttgttgtgtgcgtgtgtgtgtgtgtgtgtgtgtgtgtgtgtgtgtgttttgttttttgtttttttttactttaccttaatttctctttttggactaagatgttaaaatgtttcttaatgtgactgtctccgaaactgttttgtgtctaccactcatcctagtggcagtcattgatccttttcttgttgcgagtgtttgagtgtgggtgtgtgtgagtgtgtatatgtatttgtagagggaaaaacaagagagagggaaacagacattggagccacctttcccccactagccacgtacctgttgaaccttcaagcctctctatagaatcagatatacacaagcacagtgacagaactacatgtgtcctacagtccagcttttaagatatgataaaaactcttgtattcacagagctaaatggcaataaccataggagattgcatattgctacattatgtaaagacagagtcccaagaaaatagtgagaactcagtttgatgtatgatgtgatatgtgatatcttactttacatggctaacagttgacattctttgtggattctatattgtctaaggctacagaagagccatatgataaattcatcggcaacccaaaagaagcctgttctatcgcagtgcttccaattaatataagtaaaccactttctctggctcaatgctaccaaaatattttatgagaaaatttagctgattctgctcatgtatattttcaatggatggaaagccattgcaaacttttcaaactaaaatataaagatagcattagggagaatactctctctggtgaaaaacaacatgtattatgatgcgttaggaatttctttttttcagccaactcgtggttgagcagtctgtccccaaactgttttgcatgcggacgaaacctgtttgggcgatacttgtcagcttttcttctgacaagcaggacagaaataggcacccccagaacactgagtttgacttgactcaacatagaatcacctggagagttttaaaagtttctctcctgtaatatcccacctccagaccaatgaaatcagaatctttggagttgggaaccagggatcaatatttttttttttaagtttcccagatgattgcaatatacaggcaagattgagagtcactgtcctagagtataagcagtttaagaaacaagttgtctattattacatgcatcaatactacagagtccatgaaataaaagctttggtgataagaaaatgccaccatcctagagccttcagttaacatcatatgggcctgtcatataaagaatgcaaactcattctgttatctttttgggccttcagtggaagataatttttaaatcagcttaatggaaactgtgcttcaggaaaataacttcagtagccatatgtaggataaactggagcaggttttgtttctaggaatatgttgccatcatttcactacccttatataatcttattgattcaacttttagaaccaagactttttgcagaatatatcgaagaatgtgcttaatgggaatgctgatatatcatacaattggcatatagagcttcagttcattatcatatttaaaggtacaatattaattttgcttgtgcttaaaatgtctattataattcaagtagcaaggaagacataaagaaaaatgtgacctggctttacatctgcacatatttaatactttacatttgatggtgaataatgggaaagtttgggagtatgtcatgctcagtcaccatgcatcaactcccaaaatggctgtggacagctttggtcctgcctcaaaacaagcactgcttgcaaaagagggtctgtggcttatttttatcagttgtgtggtgatcacaggaaaaacattttaaataaaaagtttattttgccatcatgaaagaaacaaattcatattaccaaaagagaaaataaatatgacaacccagcctggtgcagtggttcatgactataatcccggcacctcaggaggccaaggttggagggttgcatgatcccaggagcttgagaccagcctgggaagcacagcaagaccctatctgtacaggaaaatattaaaaattagctgggcttggtggcgtgtgcctatagtcccagctactggtggcaagggctgagggaggaggatcacttgagcccaggagttcaagggtgtagtgaaccatgatcgcactactgccctccagcctgggcaacagagtgagatcctgtcacaaaaaaaaaaaaaaaaaaaaaaaaaaaaaaaaaaaaaaaaaaaaaaaaaaaaaaaacaaagaaaagaaaacccatatcacgctatgccacttctcttgttcaacctgtagatttccctggaatgccactattcacccatgccatccccaaaaatgacttgttaaaattctaactcttcagattagctccattattaagacttctgtaaagtctttctgttggtaagaggaggtaaatcagagatatcagaacaatcaggaagccattgcaatagcctttgaaaggaagggtgattaggtagtaggcatgtggtggaaagcaggcatttctgacacattgctgaggttgctatagatgggagagcagaggtgaaggataagaagaattgttggctgaatctagagtcagtacaaagcaatatataaaataagtaataatatataaacaccatttttggttttgtttggaaatcttaattcactgacaaagttccccatcggctgccggccctctgtcatcggatcttttgattgactgactgctcagcattggcagcaagctcttcacaccagccctgggtctgagctaatcagctgtgtttccttcatgctctgatgccttgaagtttggtactattctcctggtttctcttgtttaaaagtgctgagatacttgtctaaaagatgggccttaagattgtggtgtgcttttaataatgtgtggggtaagtgcctctagaggcaagcatacactatgcttgagtaactttctctccattctgaatctctccctaaaggacacagtttgtaaatgtttgttcatgtgaaaagggaagattcaggtaccttttctgtcctactgatgtgtggggctatttttatgttttgttcttcacttttttctgtacttgtgatttaaaggtgccagactggttaccctcaaggctagtgtccccactgtatcccaagaatagaaaaaataatgagaggcagcaaaactggcctgtgtctgagtccagcatattaggctgacccactctagaggaatattctccaaagcataaagtagaagatcattccttaggaatacaatacagtccatctgttttcatagctgagaaggcaattccgtgtcatgccatcatggagccactgcagtgttttggtatccaagccatagtcactcattctctccgtgagggaaaactagaatgtcttttcctcttccacctttacctttcaaaattccatccttgaaggttcggctcaaatgcttctttctccacacaacctttcctgagcccctgtgagtgtggttttccttccacattccatagcactttcttctaagacgtgttacatgctttgccatgtgactattgcatgtaggttgtcttgactgtgagaggcactgacatcgtgacatcgtcgaattcatttttgtatatcacacagaaggagaacatagtcgtgggcaagagtagatatttgaggttgaatagatggaccatttcaaagcttatcttttcagcctgacctttaaggctttgctctggccgttccctctaaatcagtgattgaagtttgctcccagatcctcatgagtagctatcaaactctccataagccatgtaggctcaggttcttggattccaggtattacacttcgggcatcatagtctgaatcaaaattgctacttttagctgcttagtagactgccattaccaatagtttaatgagaactacttttttaggggacggggggaagtgtggtccacagatccctgatagcccttcgtgtactatgtagtgaatctgcttgacatctagaaaagggaagagtaatatagaaaaagaattttgttgacctgcctgcatttaacaaatgtaaaatgtaaaattacagctttcacaggaatctaatatgcttttaataatcatatggattggtaatccatttactcctaatccctaattcgttttctgcaatgaaatgttgtcaaagggtggcatgaagctgttagaatttaagcatgattttcaaacatagcacattttttttgtggttttgtttttttggttttttttttttttttttttcagaataatttcaaaaatagtgccatatgaaatagttttgttactgttggcaggaaagtccaaaatgttatctcataataaaaacaggtacaagttcagtcttggataaaaacttttgaagtctgccacaaacaaatactatacaaaattttttcatcaaatgtcaagactgtggtatcaagactttataatgatatcaactgtagtggtgacagcttagtttccaatactttaactctttttccagcacttcatatttctttttggtttgagatgaagtctcgctctgtcacccagctggagtgcagtggcgccatctcagctcactgcaacctctgcctcccgggttcaagcgattctcctgcctcagcctcctgagtagctgtggttacaggcacacaccaccacgcccagctattttttgtatttttcatagagatggggtttcaccatgttgaccaggctggtcttgaactcctgacctcaggtgatccacccacctcggcctcccaaagtgctgggattgaagacatgagccactgcacccagccttcatatttcttattccttaggaaaaaaactaagatgtatactttgggttatatttaaagtcacattcaaatcccacaacaggatataaagaaatacttttcagggccaaatacaactggagaggattagaaataaatttacctttttttctctcacgttgaaacatctagccctcccatgtttgagtgtgaaatggctgtcaatccaatgtgatggagtgctgaaagccgtcttcagtgagaagtctctccataatgctccctaacatcagatccatgttaatcctgatgcacagaactgggaataggtaatatagcatagtgtttaagagcacagatgctgaagttagactgcttaggctggaatttagttaaccatttgtgtgactcagtttcctcatctgtgaaataggcataataacagtacctgcatatagactgttgtgaatatgaaatgagttaatatatctaaagcccctagaaaaagtctgacatatgtgaagcactacatttgctataccttatctatcaaagcctacagcttctggctaacattcccagtgttctataattattagatagaattttttttaacttagtagaaacaaagactaagaagggaaactagatgtggacgtgacgtctagctcaagattcccatgatggagccacatagagatatggatggcaaccagcataatgcctctcactgacataactatttgtctgaatttatattttattgttattatttaaagcttactgcaaattttaaaaactgaaacctgatgtccatatgtaggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggtaagcagttagaatgaggaagcactatggctcagtaggagaaagaaccttttagccatcaaagcgatctagaaattaaaggactgccttgggatctgcctgtcactgagagctggctgcagaggttttacaatcagggcttttgtaaaaggaactaaaatttgagtttggacccaattatcttacattctaactggatgtgtagaatctccaagaagaaagactcttctgtactgttttatagattttgccttccactccaaacatcctgagtcatgttccttttatacttgcatgtgagatgagagtcagagcactgacctcaaagccagcgaccgggttctactgttcctttctgcaagaacttagactatgagactcaatcccctcaaccgattaatgtaaaatcccctccatgccaatcttgcagaggataggggtggctgtactggtgatcttgctggggtaatggggtaatagtactggggtaatgacggcaggagtggtggttctattgctgctgacgttatgaacctgctttctcctccactttggctttagcaggactgaagtactccttggtgtgttcttatcaaacccttttttttccaggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattgtaagttccagatttgttcctcaagcactttgcaaagatgtcttctgtggctgaatgccagtcactctagatagaatatagccatcagatctttgcttcttcctagacttcaaaatgtgtgtgtggggtgtgtgtgtgtgtgtgtgtgtgtgtgcgtgcgcgcatgtaaattagcatattgtaatttttttctacacatcccccattcataagcagtcagaaaggtgtattagcatgggactgccattcagttagtggtctgctgggaagatcatcagcctgtggctttctagcatgtatgtacaagctaaaattttctttcttaaagcatcagaaagctttccaagtagctgagtcacacctcttataagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaactaaaaaattctcagtcatgttaccttagcgttttacaatgctacttacttaatctacctgttaaactattctctggtagagtaatttgatgaatgaacacagacttttttcatctattgtaaatttctttgctatccttcagcatgattttaatctttgtttaacacatgttgatgggaaaagtagtgttttttgtttgtttgttatgtaaacccacaaaacagtcatggtttgtccctcagtgcccagagatttcaacataaaagacaccttggtttctttaccaaggtattgggagtcatacttggctttacaaggttcacatttattgaagacgtttttggcctggttggtattttcctataacttggcagctctaacccattgtaaccttggggtctgtagcacagatctgaaagttcatcaagattaaggcttcgtaggattaaatatggctttgcatctgtcttaggttcaattttatttcgttttctttccaaaggtaacttaatacatgtaacatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatgtactgttgatctggaaggagcaattatgcataagcgaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagcttgaaatcatatagacagtattgggaaacagtgtaacagggtgggaagaacatgaatttgaatttcgttacgtcacttagtgcctcccctccttgggaaaattatttactctttctaagtatcagttgcctcatctatataatggggacgatggcagttattttccatgaagaagaaatgagacaatcctagtaaagcacactgggcctcttcaggaaaagtagtggaataaatgttattctgggattaactttaatgatgtttctgaaactgtttaatatttctgaatgtgggaaccttacatgtgcagtgaaattcactgggctttaggaaattattataacctttcagacatactcctcgcatttttacatgtttgcttgcttttctgagtgcgtaacaaaactggagaaggtctaatctgattaaataataggtttctacagtgtgtgggctcaagtttctatctccattccaggcatagtatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactatgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaattctctttaatcattttacatattttgttttctattttttatttattaacataatacaaatgttcatatagttttgcattgttagtattcatttttagatttttatctgtttagttttacatttagattacacacttcattttaaaaccatttgccagtcaaaatgtattgtgtgttttgcaatcttttagaattgtaaataacatgcctatagatagttaataaaaattttattttttattttgaattacatccttagcataaattctttgatttatattaccaaatcaaatttaatctggaggacttttgcattaccttgctagatttctttagaaatatttttctaatttacagaaccatcaacaataatgaaactatatgttaaaatgcaaactatcccctatggcagaagtttatttatattttctgaactaatttaataagcacattatgtcttagttattttaagtttgtgtaattattagcaaaatcaatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataaggaataagcagttgtgatattttgtatacatgaaattatttactaatataagtgcttaatctgattaacagaatttttatcattgctttttttttcccctttagtataatgtgatacactatagaaaccctctaaatctggggcaatttcttggctgtagttgctatggaaatactgaaataaataaatgtcatggaaggaatataaggacacatattaaaagcggaggttcatgctttgcttaagaagatttttatgttggtatgaatatgaagggcagcaacagtgcctcctgcttatgtacccttctgcacataaagagacagccttactcataagtatagttttagaaaaagaattgctgttttattcctagcattaccaaggagtctgggcctagggacagagtgcatcagaaattctcagcaaaagtctatttatgaagtggcagccaaggatcctcccccaaaccagtgcttttattcccagtggatggactccaggtcctaactctctgacagcagaaggtggtacagacatttttactagagttgaaatccaaatgactaaagggcctctggaaataggaggccaactccacaggaggctaaacactttaaggtacctgaaacttggcgcattagtgaccaacacactagcagccttttgctcccttatgtcatcaaatggctacagttaaaacattctaacttgtcagcctacattaagaggtagttttgtacctctgcaggaaagctgttcttttatatactcaattcttcttaataaaatgttttaaaagcacttatggccagtgctttatgtggatgttggaaaaggaagcaagagtttggactaaacctgaaaaatccacatgaactttcttcctttttttctaattgcctacgtctgctctctcacctccaaggagtgtttgtctgtgcctcttgtctctctttctgtctcacacaacacacacacacacacacacacacacacacacacacacacactttcttcttgctgttacatcatcatttcaccagaactctcctaggaaggagaaaaatggttcaagaaagagaaaaatttgtcaagcactctcttgggaagttaagcatgttacccactgggaatagttatctcttccattcatacagccccttacattttataatgctaccgagcatctgttgttgcatgctgtcatacctagtagagccttgtgaaatagatcatggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttttttttttttttttttttttttttggagacagggtctctctctgtcgcccaggctggagtgcagtggtatgatcttggctcactgcaatctccacctcccggattcaagcaattctcctgccttagcctcctgagtagctgggattacaggcgcccaccaccacgcccggctaatttttttattttttcatagagacggggtttaaccatgttggccaggctggtctcaaactcctgacctcaggttatccactgccttggcctcccaaagtgcttggattacaggcatgagccatcacacccagcccatgttaaattttctacgtgaagatcctaaaagcccccaactactcagatttaaaatcaggtataattatagccttttcccagaaaattttaattgataaccacctgactcatgctttccagtatcacagaacctgaaatgctaaacttctactgatgaaaaaccataagcccttgtattttcttgagcatttgaggccttaaaaagcaaaaaaaaaaggttaaaaatatttataacaactgacattgacattaacatttgctcagtgctttaacttttatgaagcacttttcttttatcatattaccctctaattaatgatcctagaaaatagttacagttatttttgccttcatttccagtggcaagaaactgaatcttagaaagtgtcagcttgcttagttccatagagtatgagtgtcagagctaatacttgaccctgggcctctgattcccaaggccggctatctctacatctaacagaaaacactggaaatcccatttgctgttgctaggttacctttttcccatgatggtaattcttttttaaaatcctaagtttttcattaatgtacgcccattagagaaaaattagcaaatagaagaagaaaggtatgtaattctctcatctcagtataatagttcacattttgtcatgcacttcttttctgttatgtttacctgtgggtatggaaggatgtatacaaatgtaaccacacatctgtatacatgtggttacatacacacacacacaatgagatcataccttaactattggttagtaccttgcttttgttacataacagtatatcaaactttgccttctatacagtccgttttaaatattcttgaaccactgaaaaagaatatatgtcacctacatatgctttctgaaggttgattcaaggatattttccaaaaggcaaataaagtaatcaaaataatatgcacaagagatgcatagcaaataaaatggtgaaaagcaatgaagtaataaaactactggtaaaaaaataaaggggcaaagatgtagtagtaaactcagaccaaaataagataatattaattacctactaactacaatattcatagaagaaaagtaccattcagtacaaaggtatcaagcagtctgaagaacattactttttgataaatgtcacagttccccatgaagaatagccctgagctttccttcattaaatatcattatattgaaatgtataatttaaaaatactgaagtaagagataagaagggtgaaaacatattctttataaaaccttaacacattgcttttagtctttgataaatcataaaaaggagttaaataatatgattgataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactgcatagcaatgagaacgggatggagccgacatagtatgccaagtaatactagtctcattaattgcaacaggaaacagtgcatatgtattaacttaaaaaactagaacagacaagaaaatcaaccttaaagaaatccattaaaataaaacattgttgataagttgaaaaatactgcaatgtttagatctggggatgattttttgaaaagagcagtgaaataaacatttggttaagataaccaagaaagaaacaaaaactacagaaaattaggaatgaaaaagacactcagcatagatacagatgacattttaaaattattgcacttaaaattttatatgagagactatgttctatgcaaatctaaagtacaggtgaaagaaacttgaataaactcgtaaagacagatggaatgtgaagctactacttgcaaaagagccagaaaatttcactaatcaaagttttcagatctccaaagaacaaatgatttctgtgctatttcaactttaagagcctagcaaaaaacgagatgcttaccaaatcattttataaagctagcgtgctcccaataataatacctaacctaggttacccccagaagacaattctgtgataatctaactttcataaatgcagaaatcctaagtgaaatattagcaaattgaataccacataataaaacattccagttattccatattcagtgctagaacaattaggaatcttttagcataatttgctatattgatatatcaaaattttagaaaaactagtaatctccatagatgcttttcattaaaagggcatttaataaaatttttcatgcattcatatttaaaaacaaaaacaatggcaatgcaaaataagctctaagtagtatttacatatttcgatttattatgcaacatttctaacatatataaagatatgaagcataatgacaaaggtccatgtacctgttatccaatttaagaaataaaacattaaaaattcagtagaaatcccttgggttctattccatgatcatgttcccccagagagagccactattctaaatttgttttttatcattttatgcatttctttaaacaatatgtagtgttgttagcacatagtgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaattttaggtttagaatatataacagaaaagtgtcctcatacagaagcaataaaaaatataaaatatctaggtaaaactttaaaacgtataaatgatctaagtgaggaatgctaaaaaagttttgcatgaataattaactcatgagcaaaaagggtattttggggattgaatgtgctttggaaagcctctctcactttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccctttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgagattagtaagattttggttggagagtgtagaaataggacagcgtttgctttcaccctaaccagaatgaagggtctcagatttccaggttaaatgcctctgaaactttattctagaaccttcccactgccctagtttgtttaagtcaagcatgaactcaccactcaatgtttgccagagtttggatgaatgtcagcatcaggctactgtaataatggtttaagattatttaatcccattagttatacacttcattaggctgagtgaattgttggcagtggttcagtaaacttcctcctttagagataaaaggacagaaagaaaataggaaaggagcctattcctcattttctttcatagttataattcttttttttttttttttttttttttttccgagacggggtcttgctctgtcacccaggctggagtgcagtggtgcaatctcggctcaccgcaagctccacctgccgggttcacgccattctcctgcctcagcctcccgagtagttgggactacaagcacccgccaccacgcccagctatttttttttttttttttttttgtatttttagtagagatgggtttcaccgtgttagccaggatggtcttgatctcctgacctcatgatccgcctgccttggcctcccaaagtgctgggattacaggggtgagccactgcactggccataattcttaatggataaaggaatgataattacccagctgtagcgtggactccatattagtacggtctcctaaactactcttcattctcaggagaaataaatgtttgtaacctaatattctctattagaagaaaatggacagtggcagagaagagagtgtgtgtccgtgtgatcaggccataaagttaatcttaaaagtaaacctgaaaataaattcaaagattctagatatgagagtcttttacgtagtggggttggtatgaggcagtaaatgattttaaggaaagaatatagaatttaaagtgagacctggttcacactcagccagctgctattctgcattcttccctttacttttagcttcagtttcctcacacttagaatgaaaacaaacaataagagcaaaccagtttgttatatgttctcacatctgactttgtaaaacagtttgaaaacattagcgtgctcagctccaggattgtcccatgcaggcaatgactgttacatctttcccttctttgtagtttatttttgcccagatggatctgcattcatttgtactatctattataatattgttagaattcactattatactgtagaattcattaattctattatattgtagaattcactaattctataatattgtacaattcacattatatattataacattgtagaattcaccaataatattgtaaaagtcactaataattcataaaaggaatgaattcatttgtgatcttatcaaaaaaaatttaaaaagaaaaaagaggccgggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaaaagaaagaaagaaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttatctcccatcagctctcctacacattctttttacaacacttgcccaaggtgaggactcttctcctggacattgatatggaggtttctctgtctattcccatgccattggttgcctaccttctgccttttccgatctccagccttaaaatgctttcctggaacttaaccaactagatgtaaccatttctgaacatgcaaggttttcatttccacatctctcataggattgatcctcaccacaactggtattatcaagtcactggcatccttgacacactccagtactgacaggaaccccttgaagactgtgcggggtgcggggaggtcacccttttttcttttcttttcttttcttttttttgagacagagtctcactctgtagcccaggctggagtgcagtggcgccatcttggctcactgcaacctctgcctcctgggttcgcgccattctcctgcctcggcctcccgagtagctgggactacaggtgcccgccaccaagcccagctaatttttgtatttttagtagagacggggtttcaccgtgttagccaggatgatctcgatctcctgactgcagggaggtcacctttaattcgtctttgtcttttctgtagtgcttatcataataggtgaacctattgctgctctgatagtgagggggatttggggggagcctgtgtcactctagcactatgtctccccacagtcattgactcacataccctttgcttgccccttcgtgcacctaggacctgagactatgtatgtataagaaggaaggaggagaacttggctctgagagactatgaacagagtcattgctgaaatgtaaatatcaaagattgaagggaaagatgtgagagtgaagccagctgtctagcttccagccgtagaatgatcataagagctactacactcaaggtcaaacacactgactcacccatgaaaattgccaaggagtttgagtggaagttctctgatattccaatgactttgaatgggacacggtaattccttcccacagccagggcttacttaaaataagtaaatgaataaataaagtctactccctggatcttttttttgctcttgtccctgcagagtaaggggatgccagccaaggctgacatcatcattatagcaagacaggtgctttttttgaatacttcacaaggacaagggcctggtattatgtaggtcttcaaagaatatatatatatataaatttttttaattcagtctcctacatttatagtatggggaaataagacaagagcgaggaatgccttgcttgggatattgcaattggatggctgcactgaggactatttaagcaaccttaaaatcacaaacacacatctgtgatgactttttaattatatctgtcattttggaaaagatattaaacatcttcctcagaagttatttttactttacacactctttaataatgttaaaagatatttgatgcaatttatattaataaagctcatgggacgtgttagtaaaaataaaattgaatcttctaaaatatattcctttaaaaatgaatgtctataattttatgctagtttaagcaaataatctgaataaatcctgtttgtttagcataacacatgtacacgtagtttctccacaaaatggaacgcgctaaatgtgttggggcctcaggaaagaactagtggaagggggcataggaggatttgggggcaaaaggaggaatccaaaaagaaggtcttcatggaggaagagacctgtcccaatgtgtcattcggtagatctcactttctcctagtacctcatagtcattcatttttcacccccaacagacaagtggagactgatattattcccttttacaatgtaacaaaatcaaagcttagaaaaccagggggtttggaaaataaggaatttgtgtaggattaaaatagaactttgagctcctggactctgaatcttagcttctaccttgcacttaaataaatttatgctaacagatgtcctgtcatcagataggacttttttttttctttttaatgtcggcaagtctcattgttacagctctctggtctgcccagtttggttacacctgttttgagattccttgcctatacccttccaactgaagacaagcacttcctactgtacttacagaactttcatctatgtcttggtttaatcttttgcctttgttttaaccgtttaccacttctgctttatattggtaggtaatcttacccccaaatacatagactatgagctccttaggagcaaactcattttttttttcctgttgttctttgtgtctttttttccctatccacctccaaatcttactccacatttctgaaaatagcacccaaagcaatacctctcactttggggagtatttagtacattttttaaaaaatgaatgtattatacagtctggatcaccataacaaaaatacaaggactgagtgccttaaataacagagatttattttcttatagattgagaatggaagtccgagatcagggtgttagcactgtaggattctgctgaggactgtcttcctgacttgtagatagccaccctctcactgtgtccttacatggtgtgtgtggggagggagcaagcccactaagtgtcttttcttataaggtcactagtaccatcatgagggctccatccttatgacctcatctaggcttaatcacttctcaaaggccccatatacacatactatcactttggggttaaggcttcaacatataaatttataaagggactcaatttagtccatagcaataaattaggccttttgactatagatctgtaagtgcataattggcactgattgatggattgcagatcagaatatcctatgcttctagttatatagaaactacatgcttagtgttttttttttttttttagacagagtctcactctgttgcccaggctgaagtgtagtggcacaatcttggctcactgcagcctccacctcccagattcaagcgattctcctgcctcagccttctcagtagctgggactgcaggcatgtgccaccacgcccagctaatttttgtatttttagtacagacggggtttcaccatgttggcccggatggtctggatctcctgacctcgtgatccacctgcttcagcctcccaaggtgctgggattacaggtgtgagccaccacacccggcccatgcttagttatttaacagaggtttattgagcactgtgttggctttaaacaattttgctagacattcagtagggcctgatgagtgtttaagacctcgtacagttcaggtgcattttcctttaaggatacatttaacctgctagatgtcatctcattttgaagacaagagaaaaagagaggaagacttgttttttcagagggttattatacattcctattagatcattaggaaattggcacaagtggcaggaagccaaactgacctgagtctggctgggcagtgtctgcaggttactccagcaaagctgctggaataacgatgtgttcttccataaagtgctttttgtcaaagtctcttctggaattaactcctcatgcacagatcgataaaccccaccaacttgccaatgtaattaagaagtgacaggttaagcataaccattaattaagttcaaagtaaaagaaaatgaagaagattgtttttgtgaaattgtgctgtcagatttttctcaagggtatttctgagttcctataaaggggaatttaggaaagggaggagaagattgtctccacttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacagtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaagtatcaaatagtcttagactcattgtcttcctctgatggcatcttaatggaattcaatacaaaggccaaaattcctttgttttgaagccacaagaaaacacagccaatggaaaagccgtgttagtgctgcctgtcctattctgataaggtgaatacttaaaagctatgaaagaagcactgagtactgctggacagtttgagttcatttggctggtagaattgagtggaagtcaattctcatgccatttaaactggaagaaactgaagattctccaacccaagctcctctttttgcagatagtcaactgaagccctgtaagactgtagttttatagataaaaaagagccatgtgaatttcctaaatcacataacagtcagtttattatttgacatttatggtacattcacatggaagagaatgattagacatttccaggagagaataacgactcccaattccctgagttaccattagatggtattaagcaacttcacttaattatgtacctgttttccagttatgttaattatacatcctttagcatttaccacctgtaccaatcatttagcataataataccttatacttaaatgcaagtacccagaatacttttatagttgttttcatttgatattcacaacaatcctacaaggcaagtgttatttctagattagatatgagagaactgaggcatagagaaggtaacccatatagccaagaaactaaaacagggttctgacatccattttctaactatgcatctaggtttttttttttttttacctctgcgtctaagttgcctgcctaaatcgccttcagtccattgaaatccatccaatcaatatttactgaacatcatctgtatttcaaatattgtagtgggcattgggggtatgaaattgcaaaagagagaatcatcagtatttgggaaactcactgtttgaatgagatagaaagccaaacagataaatgggaattattttaagtgccataatgggtctatgcactgtctttggagattggatggacagggtagcaaaagattgaggagctaattttgctgctgtttatctaagcatgtcagggtcctgtcttttcacgtagattatgagtgtcttggcatgtcttttgtctctctgcatcccccgaggctccttgcacagtcctcacactccactggcgttctgttaatatttgttgatgatgatactggtgattttttctctctgacatccagaacactggagagattttctgttggcccttgggtataacagatttttatttatacatttgaattagccttttagaaatcattcttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgttaacacatcaaaatagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaccctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgccactaaattatttttttgaaaaataatacagaaatttgtaagcagacacaacagctctagtttatccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgctgtcagcatggtatttcaaatgcttcacaatttgaatttaaactagtcaatgggatcattaagattattatgcatgttttccaaagagtttgaattcaaatgacaacttaaaagaaaaaaaaaaagatgtccttgaaaaactaaggaatgttagtgcacttatagaaattcttgcagtttggagtaatttgccacctccccttctgaaaaagtacctgatgatagtgtgcttgagagataggggtattgcagacatattccttaggtgagtaaaactgaattgtaaagtggatgctatggaccatggattatttcatttagtacgattgacagtagaaaatcaggaagggacgtgcatcagtgcgaggctgacacacagatctgaggatggcagaagctcactgaatagcacacgcaaggacccttcaaactcatcacatgtgccgtttggttccctttcaatgggtcggtcttggaatatggaggtctgctttcattttgtgccaagtaaccacgtgagcagtttacaaaagatacaaacagaaggctgctcattcatttttcaaaaagacttttttttttttgcaatggagtttgcaaagtgattttgcaatggattttgcaaaaaaaatggatgccattttttttaaataagtgtaattccaatgatgggaaatttactagctctcaaggcagcttttccttgtgttgaaatctctaaaggttaaaaagttactttttggaaagaagtctatttccttacaacatgttttcattggtccatagagaagacagctaatacatcttccacttggcagccttttaagtatttgaagaaaattctcaagtccatctgaatcttctgttttggctaacttctagttccttcatccatttccaacctaaatttgagcctaacgaacagatttcttctttcttatttaaatatatatatatatgaggaaataaaggcacagagggcttaagggagttgcccaagaacatagagctggttggatgactggaatgtaaggctgtgtggctctaaaccttgtcatttagactagaacacctatacgtcagttagcttcctgccacttcttgttttctgcctggataggactttataaagagtttggaagaagggagagttccgacgaggtacagaaatcagaacttccccttcttccaaactatatacaaataatcagttaatcagattaaaggactcttagtaacattgaaatcaaacctttgtgtttccaggagctctgagaacaacaatttttttggagcattgcaatctcttgagtatccaaaatgattctgtaatgatgtctgtgaggtcagaattggagcagcaaatggaattcctttaagggcttcccatcaatggacagctgattccagaaatggaggaggcacagtttgtatccaaattcataagcacaagtgggagaaattaggctttggtaaagagggtgacattcccaaaggaatcatctgtgaagttggggaaggaattcaagctcagggctgctgttctctaccaggttcttcagccagctggacatgctccccaggtttctactcagtctggaatgttagtaaaagtccacttcctctccttgtttctcccttctagtgaaaacgttcctcttctctaccttcctgacctcaagaccattgttccacacatcccccctcaggatcccaccccgccattctcattctcattacattgtttctggatccatgtctttatcagatgcagcccactgtccctttcagaagatgccagaaaatttacatatgtgatcaaatgttcccatcacaacagttctttccagtaatcccagtgctgggcagctgattccagtaatggaggagacactttcagctattaggcaatggatcacactttcaaaggagattgagcaatctcctcatcaagttgtacttagagcacaaatctggtgccaaaaggcactaccggattcagactgacagcactgagagttttgagtgaaagggaagttagactggtgttatgtgtattcactgggaggaactcaccgggagaaataaagagggtttccagtttattcattgtgtaaagcggctataatagtatttataggggttttgtgaatgtcaaataaaattatatttggaacagtggctagtgccataagtaggacttaacctttagcaatatgtactacattaaaaggaaggtggacacatgagtgatctctagcattttgtgactggaaggaaagagactggatgaccactcttcagagatgctatggacagtacttttgtcaaggactgggagtggagaaaatgacttatagtggtctttccaacatgaagtttgtattaatccgttttcacactgtgaggaagaaatacctgatactgggcaattataaagaaaagaggtttaattggctcacagttccacacggctggggaggcgtcaggaaacttacaatcatggtggaaggcacctcttcacagggtggcaggagagagaatgagagacaagcaaaaaaggaaaagccctttataaaactatcaccccctgcctcggtgcggtcgctcacacctgtaatcccagcactttgggaggccgaggtgggtggatcacgaggtcaggagatcgagatcatcctggctaacacggtgaaaccccatctctactaaaaaaaaaaaaatacaaaaaaattagccggacatggtggcgggtgcctgtagtcccagctactcaggaggctgaggcaggagaatcacttgaacccgggaggcggacgttgcagtgagctgagatcatgccactgcactccagcctgggcgacagagcaagactccgtctcaaaaaaaaaaaaaaaaaatctatcaccccccttgattcacttacctcccactgtgtcccttctacttcacgtggggattatgggaactacaattcaagatgagatttgggtggggacacagccaaaccatatcacacatgaaacacagaaaaaggacatctttttacatggatcttctgatatgcttgtaccaaagcccacagtatatcctgtcttcttgaaagagtatcatagttattcatttgccttggatggaaataatgttgtaataccagttaatacttttttcaactaaagggaatttggcttcatctccagttgcaaattcacatcaggaaatatcaaatccaaagatcaaaactcagtatctcatcactttcaggaccatccttgccacttgtctcaggcatcatgtacctggaagctgaaaagcaatgtacagaacctttgaattggagagatatcaatttgaacccagatcctgctacttcctacattgtgaaagggatcaagtttctttagttctctaaagcaaaggtttttcatctataaaaggaggttaataaaagggaatacttatcatgttgaattaatgggaatattaaatgagtttatgtggtttaattgcctagcacagtatctgcctcctaagatatgtttaataaatgctaactgtgactatagagatttaccctgaagatacctgtcatgtcatgccttctctgtcaaatagatcatgaatgcagttcctagcctctctctcctgttataccctcctagcaatattctgatgcagatgaacccagccacttgtcttttgcttgccagaacagctgaatgttgctgggaaaaaaaaaaacaaaacacagccgggcataatcatatcattataagttgtgaccagccttgacctgcgccttgaccccacccacagcctacattcttacaccctgctctcaactgtttcagacattctctactgtgacttctatctcccttccccactccttccttctcaagggatgccctggcctcattcttcatagtgaaaatgaaagctgccagaagaaactctttcagcttctgctctcaaatctgtgcccatcctttctgtcccttagtgcctatcagattatcagttgccaattggtctccatgtatctctggtccctttttcccctgtcttctgagtgccctggctccatggatcatccattctttatcctacccaatgggattcttctcgtcaacatccatttgtgccccagcttggcccatattttccctccattgactccacagctctctgtagctattgctttatcccttccttcacagccaaactctggaaagttggatattagaaatgctgtctccacactattcacaatagcaaagacatggaatcaacttaaatgcccatcagcgacagactggataaagaaaatgtggtacatataccccacagaatactaagcagccataaaaaagaatgagatcatgtattttgcaggaacatggatggagctagaggccattatccttagcaaagtaatgcaggaatagaaaaactaatgctgcttgttctcatttataagtgagagctgaatgatgagaacacgtggacacaaataaggaaacaacaagcactgggatctacttgagggtggagggggagaggagggagaggaatgaagatagctgttgggtactgggcttcatacctgagtggtgaaataatctgtacaacaaacccccatgacatgagtttgcctatgtgactaaaccttcacatatacccctgaacctaaaataaaagttttttttaaaaaaagaaaaaaaaatcctgcctccatttttctatcaagtattctgcctgctaccaggcccctatcccttcatagactagctgaggacatcagggacttccatgttgccaaaaccgtgagtctaatcagtgtttacctaacttgatatctcattcttacaaaactgtccctcccaacttccttggcaccccagcctcccgattttgtttttaatttttcaataggttattgggggcacaggtggtgtttggttacatgagtaagttcttagtggtgatttgtgagattttcgtgcacccatcacccaagcagtatatactgcaccatatttgtaatcttttatccctcgtcccccttccacgcttccccccaaatccccaaagtccgtcgtatcattcttatgcttttgcgtcctcgtggcttagctcccacatatcagtgagaaaatatgatatttggttttccattcctgagttacttcacttagaataataatttccaatttcatccaggtcactgtgaatgccattatttcattcatttttatggctgaatagtattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatattccatcatatatatatattccatcatatatatatattccatcatatatatatattccatcatatatatatattccatcatatatatattccatcatatatatatattccatcatatatatatattccatcatatatatatatttccatcatatatatattccatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattcatcatatatatatattccatcatatatatatatatatatattccatcatatatatatatacacacacacacacacacacacacacatacccacacatcccagtttctttatccacttgttgattgatgggcatttgggttggttccatgattttgcaattgcgaattgtgctgctataaacatgcttgtgcaagtatctttttcgtatgacttcttttcctctgggtagatacccagtagtgggattgctggattaaatggtggttctacttttagttcattaaggaatctccacattgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatattaaacatcagtgcaggctgggcccggtggctcatgcttgtaatcctagcactttgggaggctgaggcgggtggatcacttgaggtcaggagttcgaaaccagtgtggccaacatgctgaaaccctgtctctactaaaaatacaaaaaaaattacccgggcatggtggcgggtgcctataatcccaactacttgggaggctgaggcaggagcattgtttgaacctgggaggcagaggttgcagtgagccaagagcatgccactgcactccagcctgggcaacagcgtgagactccgtctcaaaaaaaaaaaaaaaaaaaaaaaaaaaaaccaaccatcagtgcagaagaggatgtggagtggagagactgcatcaattatattttgctgatgagaatataagatggaacaaccattctagagaaagttttgggaatttcttcttttaaaactaatcctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaaggctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgttgggggaaactggataaagggtacttagatctctacgttatttctttcaacttcatatgaatctacaattataagaaaatttaaagtttaatttatagaaaaggcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagcatttaaagatgttgactctatctttgtttcatttgacttctatagcaccgtacactctgggttttcttcctatcgctgtacacaactttctaccgtttttaatagatttcctctcttcattccttaaattctccatttttcttgagttctgccctaatctcccttcttgtctcaatctgtactcctgagttatttcatctgcttccgtgagtacaaatatcatctgtgtgctgagaactctctggccaaaatctgcagctggatctctctgtaagctccagatatgtatctatcattttagcctgcagtcttcatagattggcccataggcccacaaatgcaacagtttcagacagaacccaaggtgttcccttttaaacctgctcctctctgtgttccttttccatgaatggcattaccttgttgctccaaccaaaggcacaggagctggcctgtatccttcctcttccttcagtatcccctcttatccacttattaaccaatttctgacataatactttggcttcctttatatcttctttcatttatgagacaagttccttcagtgttttctagtgacttttcattacttggaagagacagttcatactcctcacactaccatgtaaagagctcatagccacatgcacacacatgcacatccacttgtgcacacatacctaaacacacacccaaaacagagagattgtctcatgcctgtggctgggtaaacacttgtccttgatggaatgtgtagctttcccatctccatcccaatcacctagccaaaaactctcctccttcaggcctccatttagacatcacttttccctcaagtatgtgtgattcttgtgccttatcctccccatcatcctgtaatagcatcctctgcttttcctcatcatagcatttagaagactgtatttaaattacctatttgacacatacctcagtagctatacattttccctaaggggagggttgatgtcttgtttctcattgcatcctgcagtaagcaccgagtaagtgtttcttgactctggggctgtactgagttgaagaaggatgacatcactgactacagaaccctttgtataagcatcaaaggggtagcagtggggtaaatgatcacatcctggctaaatggttccgattcctacaaccctgcagcacgcccccccggctctaaaccttttagtcatttcctgtgaatcttgccagcactcatttcattttttgttttttccattttcttcatctttcccacatagtatagaccagaatgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaaccctttttgttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtctctagttgttctgtatataaaagctaaacttcttcacatgtttctgtttctcttgtttatgcgatcgtttgtcattggccttgtgttggtgatgtatgttctgaatgaataggctccagcaattaagtgactgagatgaaatgcttttgtatctctctagcctcatttcttttttttttttaccactgtgatgcaaacacatggaactactgttctccattgcaccatgattagtctatccgtagtcttttgtgtgtgatctttctgtacctagaacactcgtcttgggcttttgcctggccagtacattgccatccttcaggtctcagctgatttttcacttcttccatggagccccctctgacttcacaagattgcgttgtcctgctcatatgtcctgctcagagcatgctgcatgtctcacttcatagcacctgttatttttttagtatagattttggttttgtttgcctgcaccccattccttgaggacagggaaagtttctgtccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacaacttaacgcccttcaagattttgtgtaacagggaaaggagagaacacctggaatggttcccgcttggagaaacgtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagcttctctgatgcagtgcagttcagtgcaaaccaacggaaagcccacagtttttttgtttttttggttttttttctaggtgtaaacaaacctggttgattgtgaggcaaagaaaaataacaaaaacaagtgagaatacattagattaatttactctttcttttttcccgctcattcataatgtgattgaaatcagaagtaaagaaagtaaaatcagagtgagttccctctgctcagtcacccaccctgatcacaagacttttggaatactgggaggcactgcatttaagtaagtatcagctgtatggagagtatgaggttaagatgatgctggatttaatttaaagtctcctcactggtttgcgtgaaggaagatttttatcaagcagagtgaaagagacagaatcttgaagcttccgcagaggggaagaagacagggccgtgcactgcgagtcagtatgcctccagtccctctggtgggcaccggtccacatcacaggaagcccagctgtggtggctgtcagtgtcagaggggctggcagacagtagtagaggcccagagaagttactttgtacgtatcagtctagaaggaagagattatgaagattagtcaagcctccctttctcatttatccttttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatgttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgggcaacttttctagccttccgtctaattgggtttaatatcagtgaaagaatctttaagaaggtgtgcccttaggtgctagggccagtattgtaggtggcaaccaggtacattagtctctgcccttgtggaactcatattcccatgtttgtaaaggagtctgggcctcttatatgtggtaaatgaagtgactgtctatgtagttgcctttgcaggacacaagtccttgccttagtttccctccagccaggactgccccaccgagactattcatagctccaacttaaggtgctttaataaagggcagaaatcatgacaagaaaggacgcttttcttcaggcaatgaattcagcctgattttagaagctgttttggagaggtctctgtaagcatattacattttattccctgcagtacaatatttatacatggataatttgtattgacagttgatagttacatagaggtatatctcactggttctcaactctagctgcattttagaatcaccaggagaattttctttttcgattctgatgcctaaatctctgccctagaacaataaaatcagaatctctaaaagtgaggcccagacatgggcagttttgttattatttatcattgtttaataataaatattacgtaaaagtcagacttttaatggctcatttgtagggaggagaacttgccatttcccaaagtatcaccagcataaaaggtgaatttgtattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcgaggagatttgagattcagcacaaaaaagaattcgatatcacctaatacaagctgagaagggctacctcagggggtccttgtgcacctcactaaggaaggtctttggcagaggcagagaccatgacaaaggttttttttttctttattggacaagagccagaaaaaaatggccccaagattatgctcagccccgggaacctacagaaaccatggagcagtaggaatgggtagctagccgtgttagaagtaaatttgaggccgggtgcggaggctcatgcctgtaatcccagcactttgggatgccaaggcaggaggatcacgaggtcaggagatcaagaccaacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcatgccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacacgtgattttcttaatgtcttagtttgagcaagtaattctaactactctagcaaacacatttttaaatctcagggatttaacacaatgcaagtttatttttgtctgacaaaaatcccccatgtttagccagtgcattccacgtgggattcagagactctgtcttattccatccagtggttccaccagtctctaaagcctagaggtcctatgccagattatgtgaattaaaattagaagagagtattaaggatcttctgggacagtggtgggatggttacagtttccagactcataaatgtaaaacagtgttccttctacaaatattctattggctggggctcattcactttcacacagtaacaaagaatgcttggaaatgtggccacactgtatacccccaaaagaagaggaattagtttggttcaaatttatctagtctctgtcatgctttcatcatcatcatcatcatcgtcatcatcatcgtcatcagctactgtggatcagcatactttcctgcaattttccaaatcgaattttgtggttatatattaacagagtatataaaattcattttccctacataatatgtattttattcctatatgtgttttctgcagtggtctgatttatatcaatgactaacatatagattcgatttgcaccaactagataatttaatctcttactcctccttgttgacagttggtggggtgcgccttatttttgaagaagaaaatgcttatccagttattcagccaatctcagttgacagcctatcacatgtcaggcactggaaattccgtggtgagcaaaaacagacaagtggcctgctttcaggaagtttctattctgttaagggagatggacagagtgttttaaaagaaaggagtattgtcctaagataattaaaacacaggaacctgacttagacagagattaagacaggcattcctaaggaagtgatacttcactgagttatgaggagtgagtaggagtttagacatctccagacagtgcagcacgctgatttgaggaactgaaagaaggccagtgtggtcagagctcagagactgagggagaagcatgatgcaggatgagttttgagagataaaccatgaaggacttaggccttgctaagcattttggcctttttcccaaaagtacaggaaagcctagccattttattattttataccacccatccattacaggcttttcctgaaaggtctttggcaataggggagctatggaagcaacatcatgagtaagtgactgggggaaccttttccctaagtgttgtggttgctagccacacaccatgtattcaacatctctccaactctcctcatcgtttcccagagctgaaagtaagatgagcacgaagaaaccatgtttagttaagaacatgacccgaagagtgaaaggtatttcctgttccaaataggagcccagtctgcattttctactacatgatttagtagaaagacacattggatttgaaccatatttcttctgctagccaattccatcttatctacaactttttgataattattttgagaaatagatctagatcacagccttccaattcctaggccaggatactttccatttttctacacagaccccattgcagtcctcccttcttcacaatcttcaaaatatccttctgattgaaccagatatcttattcttcatcccgtttcctgccccctaaaatgacctatctttcccttctaaaacttccactaactttaaaattggagctcaaggcttccatctccacagactctgccctgacaacaaattggttggttttattttcttcccaatgaatagaatagccgttagagggaattgtcttcagctcttttcccctcctcctcctcctcctcctcctcttcctcttcctccttcttgcaaatacaaacacagcagggctctatgcagctggttactctaggctctggtaacctaacatagcaggggaggacagaagtcaatagcgtgagaagtctgtttttgtcacggatttgctagaagctattaaagtgttcttcctaagtctgttacttcataggttgagggaagtaatgcatcccacacaagaggactgggatatgtttaaagtagtaggaaggcatttgccactattctagtccatcctgcccatgctgcctaatgtttgttcctacagatcaaaatctcataatcttctagacttctagatacagaagagttggagagatcaaagccttgcctctgacccagattattcgatctcatctggcatatcctacactctagccatcctgacctgccgtgtgttcccctaaagctcccatccttttctgactttgcttttcctcattctgtcccctgcattgaaatgcctttcccacatctctatgtctaaatcttacatggccaattccaacgtaatctaatctctgaagattccctttgctccccagttagaagtagtcactccctgctctgctcactttttgacatatattaatttatatagctatgcatttatatgtgtatgtattatattccttacaagagaagcttttgagagaagggcctataacttttctttctatttgtgtttcccaaagctccttctggtgggaaaaatgctttgaggttgaattaagctcacattgaactctatgatgaaaccatttgcttatgaacttggacaagtttctttacaactctgaaccttctgaattttccaccaggagaatgggaatgaataagtaagaaaacttataagacagctcctggtgtagggcctgactcatgtcaggttcccaggaaggccactttatatccttcatacatttgtatgtctgtgttgacattgaatgtttgcatgacatataaaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacataatagacaatgccactcataaatctagcccactctaggaacataataaggcctgttgagacattcagagatgtctccctgatcttcaaagatgaatttttattcttccctaagctgctgtctcttcagtctcaacatcctaagttcattttatctttcctcacaggtcaggttttcagctctaactgtgttcatcctggtggctctgccctggacatactgcagttcttttatgtacctcttatcgtatggggtacaatggctttcggtactgctcagtgaggggagagaaatagatagtgtagtttctgatgtcaaggaacactttagagagaccttaattaatgtagccatatgttgacttcctggagcactcataacaacatgggaagcccacgctgggaagatgctgagtaggaataagagaacaatgctaagagaagggaaatttcaccgtctgtgaagcgtctgtttagattttatgtttaaactttatgaactctgtcacttgctggtgaattttcttgctcagtatcttaaaatacagctgcagtgtgggttccaccctcttcacttaaaagggtgattaactgtttgtgatgaataattatttaattgccagttcagctacatgtgtgtagttgttttgcttctttcctcttcagtgtgagccaaatcttctcaataataaaaataatccagaattagtcaactgccttttatcatgttctcattcagcctgctggagcaagaacattccaattctacatcacctttagcttaaaaagtaaataaatagaagctctcactcagccagttgatagttttactctcacagcctctcctgtaactaataaagtcttgacttcatcttgaaccttttactctatctttggataaaaatttaatcagaaagaattattgctcttttaatacctgtttaacctttacattcgcgatgggtacaaaaccacttaagatttaaagctctcttgttatggacttgtatgctgacctacttttcctcagagatattttttgcaagaattgttgaagcttgacatggggatcactgcaaatgtctcagctttgccattcactgctttccattcctatgtcctccttgccctgttaattattttaacagagacttgctattttaaggaagctctttatcgttactaaatctttttttattgttaaactcctttttctttccagcatagaagtatgtcatgttttctgtcttcagaatgtgcaagtgcttaccttctcataaagtgtgcctgttaccttaattttatagtctttatcacaaaaaggtacgtaagtggggttcagaatagtgtcttgcacttaaggtttaacttaggttttagtttcttcatgcaagcaacttgcatatgtagagaggcagcatgctatatagtgcaatgttcttcttggtttttaattataaaagtgatttcttttctagtaaaaaatcaagttatgcacaaatatatagagtgaaagtgttttcaactcctctctctagaggaagccactagcagttggcatatttccttccagaatttgttgtgtattataaacctatatacgtgcgtatgtatacacacacagtagtacacacattgttctgcaccttgcttctttgttttccctaagaatgtatgcttgatatatttctaaaaataataatgtatatgggtctaagtatttttagtgatatagaattctataggatacatgaaccgtaactcccttagtcatttctctactgattagtatttaacattgtttcttttttttttttttttgccattaaaagcaaatatctttgtgcaattatcttcatgaaatgttgaagctttctttttttttttttttttgagatggagtctcgctctgtcgctcaggctggggtgcagtggcgcgatctcagctcactgcaagctccacctcccaggttcacgccattctcctgcctcagcctcccgagtagctgggactacaggtgtctgccaccacgcccggctaattttttgtatttttagtagaggtggggtttcatcgtgttagccaggatggtctccatctcctgacctcgtgatccgcccaccttggcctcccaaagtgctgggattacaggcgtgagccaccacacccggccaaaactttctgcaggatatatttttaaaatgggttttccaagtcaaaagtgtatgtatgtttccattttgatacctactgaaatagctctccaaaagtgaaaccaaatttattcttttcaatggtatgtaagaatgcctgattccccatactctcattaaccttgagcatgttccatcttttaaatttttgccaagaagattgtctaaaaatggaatctcattgtttgtatttgcatttttatgatttttggtggatttagcatcattttctatgcttagtaactgcttgcctattcatatcctttatccaggttttttgttttgttttgtttctttttggtttggttattcatgttttccttattagtgtattggtagttatatgagttttaaccctttgtcagtggctaatttggaactcctccacagatccctgggggtttcttagagcagctgactggctggcagagctctccatggccttacctccccttcctcttctccgaactcacacacacactgatcgaacagaatagaccaattattacctgcatttcatgttgggctttgtgcttgagattaaacaaaggttcccggggctaaacgtctaaaaaacattgccatggaatgaagagccctagattttgtcataaagtcatctgtcctaggctctacaatgtagcattttcaaattggaagagccttcagagattattttattaccaacacccatgtaatataaattatacagttaatatatgttgatatacatgcaatactgaagaaatctctaatgcattctatattctgtaacagtaatatgtattttattatttataatagcttcaacatatattgaaaactagaggcacatacgtctataaacagtgctcagggcgtattattttggtgtttatttatttattaggtatttattattttatttagtccatagatgatgcatttatctgagaactcctctgactcaaggcccagcaagaatctgctgcccacagttatgagtagctgaactgggccaagcttttaattctataaatagcgaatctatgtagacactcagctagttagtaccagagtggtacccagatccgtgatgtcttgactcttagtacagtgcacttttccccactttgccattctttgctggtgaccttgggtagatcttcttaactgctcagagcttcagttcttctctcttttaatgagagtaataatgcatgcattgatatcctgactaggatggagttggataaagactgttcttaccttttgtgaatagcatagtatcttacagaattgtgaggaattatccaagtagctattgcccctcatcatggtgttaaaagtaggattgctagtttgaacggtaactgcaggaattcaatgtgttttgattttagcatattcccgtatcatgtagaccagtgttaatatttttagtattttatcttagttcttttttttctgaaagtcttgatttttcccagttttattttttagatttgaaagaaaaagaaaaaggatgtaactatgactcttatgttttcaatctctctgaaatataacaaagtaataactctaaatggtcaacgtagtagtctgagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacatccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccaacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatttaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaattgttgaatgtaggtgtaaatctagggagaaattacatcttaacaataattatgtcttccagttcatgaatatacatgtctgtatttatttagattgttaatttctttaattattgttttatatttttcagcgtaggaatattgtacatatttcctaaggtttataatgaagtattccatgttttggggtgcttttacaaatggtgatttaaaaatatgcaatttcaagtattcattgctactgtatagataagattgatctttgtatattgcccatgtgtgctgtaactttgctaaaattatttattctagtagctttttttttattcggggggaggtttaatgaaaaaaattatgttttcaatgtagtgcatctttatatatatatatatatatatatatatatatatatatataaaatggaatacaattcagccataaaaaagaatggaatcatgtcttttgcagcaacatggatagaactaggggtcgttatcctaaatgaaataaattagaaatagaaagccaaatactgcatgtggtcacttataaattggagctaaacaatggaaacatatggacatacagaatgaaataaaggtgggaggatgatgagggttgaaaaaatacctattggatacagtccagtactcactcttcggtttatgggtgcactaaaagcccaaatttcaccactacacaatatatgcatgtgagaaatctgcacttgtacccccaaatatataaacattttaaaagatttaaattacattttctgtgagtagaaacagtttcatttcattatttgaagtcatgccttttctgtttcttgcccaattgccctggctagggactttcagttagttgttgaatggaagtggtgaacatgaacatttttgcgctgttcccaatattaagagaaaacattgagtcttttgccattaagtgtaatgttagaagtaaggttattgaacatgctctttattaagctgagcaagtttccttcttttcattagttttctgggaggtttaatcatgaaagtgtgttgaattttgtcaattgcctttagacataagttggtatgataataagacttttgttctacagctggttcatatggtaggtaacactggttaatttttaaatgttgtatcagccttgcattcccaagataaaccccacttggttgtgttgtactactccttttgtgtgttattggatttaatttgccagtagtttgttgaggatttttgcatttgtgtcatgaggtatactaaactgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgcttaagttgcattctacaaattttgatatattgtgttttcattttcattcaagatattttctaatgtatctagtaatttttttgacgcatggtttatttagaaatgtgttatttaatttttaaatatttggatattttttctaggcctttctgttattgtcttttagtttatttccttgtgatctgtgaacatgttttgtgtaacttaaattcatctaaatttgttgaggtttgttttatgtgctagaaatatggtatatcttggttaatgctctgcacatttcaaaaatatgtgtattctgctattattaggtgaagtgttctatagttgtcaattaggttaatttggctaacagtattgtacaagttctctctattcttactgattttctgtcttctttttcagtaaattattagagggatactgaaactttgagcataattgtaggtttgtctatttctcctttcacttgtatggtttttgttttaatgtattttgaagccatactgttaagtgcacatacattaggattgttatatcatcttaaccccatattcaattccttccttattacataatatgattctttaactctgaaaatattcttgttctgaattttagataatattaatttaactttcttttattagtttacaaagtatttttccagccttttgtttttagtctatcaatgtctatataattgaagtagcttgcttttagacagatacgtctttcattttatccaatttgaccatctgtattttaatttgtgtgtttacactatttacatttgatgtgattattgatatagttggattgaaattcacaatcagcttttgttacttttccatctgctatatttttctcttcctgcctttctttgaattaaatgtttttcacaattccatctcatttacactatttgtttattatttatactcttgattttaatgttagtattaccctttgatttgcaatatacacctttaattaactagagtttaccttcaaatactattatatcactgtctgagtagtttcaggaccttacaattgttactctcaatttacttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattggttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaagatagccaatatctcttcaatttttattttgttttggtggtttgttgccttcattcttttatattttctctttggagttctaactacatacaggcttaatatttttctataattctttgatgctctgttctcttacttttcactctttctataaatttctattgacctatctttaagtttactaattctttccccagttgagtctgcttatgagcctattcaaagtattcttcttctctgttactatgattttcatttctagcattttcattttattttcataagacagaatgagaaatattctcatatgacagtctctatatctttgagatcatgcaaattttcttcctttttcactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagtgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatatattgtttcttgactttttaataatcgccattctgactgtcatgagatggcatctcattgtgattttgatttgcatttatctaatgatcagtgtcattgagctttttttcatgtttgttgactacataaatgtcttcttttgagaagtgtctgttcatatcctttgcccactttttgataaagttgtttggttttttcttataaatttgttaagttcctctagattctggatgttagacgtttgtcagatggatagattgcaaaaattttctccctttctgtaggttgcctgttcactctgatgatagtttattttgctgtggagaagctctttagtttaattagatctcatttgtcaatgttagcttttgttgcagttgcttttggcattttcctcatgaaatctttgcccatgcctatgtcctgaatggtattgtgtaagttttcttctagggcttttatggttttgggttttatatttaagtatttaatccatcttgaattaatttttgtgtaagatgtgaggaaggggtccagtttcagttttctgcatatggctagccagttttcccagcaccatttattaaataaggaaccctttccccattgcttgtttttgtcaggtttgttgaagatcagatggttgtagatgtgtggtgtaaattctgaggtctctgctctgttccattggtctatcagtactcttattctgcctcaggtctttcgtgtgagcatctgctgagatctgaggaaaagagtataaattaaattccgcttctatctgcactgcccaaagattctgtgttttaatactaccctacaactagtctcttgcaactggttaataactgtagttttttttttctgttaccaatagtatggcattcagaggccttaaggcagtaaggcatctgccttagtgttctgcaagtgttcacatcctgtctctcctcagaggcatctatctttccttagatttcaggttacagtagtttccccaactcccacttatcagtagttttgccttctgcagtctcagttacccatggtcaaccacagtccaaaaataggtgactacattacaatagtcatgtagagactattgtctctctacaaagagagagaaagagagagagagagagagggagaccacatacatgtaacttttattacaggatattgctataattgttctacgttattattagttattgctattaatcttttttgtgtctaatttataaattatactttatcataagtatgtatgtataggaaaaaacagtatgtataggggttaggttgtatccacagtttcagtatctactggtggtcttggaaggtatcttccacggataaaaggacactacggtagttggttgttctgcagcctcagttctctatggattcaaaaccagttttagatttgcacactgtctggcttgttttaaattattgtatgggtgggagtggtgctcctttcattttctccatcttgtacagaagccataattattttcaattctatataatttttgattgaatgaaaaataccataatttttttgttctattagtagacatttgaattatttatggttaggttcatgacaacaaggaatgcttctatgagcacatgtcttttggtgtacatatataaaatatttctcaagggtatagatgtaggaatggaattcattaattgtaggagaatacatacgacacacacacatgtatgagttatagggtatatatatatgtgcatataatgatttcagtaaattattgatataaaaattttcaatgaagtataactcatagaaaagtgtacctatcttaagtggccataggatatcatttagactgtaacataagagaactatagatattcacatccccaagcattaactgagaacctgttatacagtgggcatttaggaaatgaaaagtgaaggaaaagttactgaccttaggggtcttgaaagcgagaaaatgattaagtgctgtatacacacacacacacacacacacacacacacacacgcacacacgctcaaagagtagggagagaaaaattatgattggggaaatcaataaaagcatattggagaagacatcatttgatattaacctttaagtatagcagtgtagatagtgcgtaagaattggattatagaacttagtcattatgttaggaaagaaacctatggccttgttttatagcaattactggggatatccaggtcttttgcactggaagaaataatcttagaaccatttattaaggacagacccttacagatcatggggtccaaaactgtcttggggtcgaaaactttctcatcttatagatgaggaaactgaggcttagggaagggaagggacttgcctggggtaaatttttgctagtaaatgtacttaatgagatctctcagttacactgaaacgtttgagtattggaacattgtgcttttgttgttttctttttctttaaatccttaaaaaagttgtggatacatagtagatgtatatatttatggggtacataagatgttttgatatagacatgcaatgcataataatcacatcacggagaatggggtatccatctcccttcaagcatttgtcctttgtgttgcagatcattagaatattgtcttcatcattcttttattccccaccaaagtttttgtaaggtagtaagaggatctttgtggaaagaattcttattcccttacgttcctcctggtctgttcctaggtcaaggttgagtacgtttatagatattctataaatatattttattttcaacattaagtgtagttcatatagttgatgatctaagcaataagaaataaagtaaaatctggataattttggttactctgcttttcctctgtgtgtttcaactacaaaattcctcactacaatgctccccaattccttttattggtgcttgcagtgccagtgggcaaactgaattcttcatgcaaccaaagaattccaaaaacgtatttcttgcagctagcataaatctccagttccacaatggtagcagtggtggattttacccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaaggactaaccctagaatgacatttttccctcattcctgggtaatttttgagatttcccctcatgcccaggagctaattatactctctcactctccctctctctctctctctctctcgctgcagctttctgtatgtgtgtgtgtgtattatatctaagaaattttactccaaacatctaacattctgggtacgggtttgatttggggaaaaaattacacttttttttttatcctttagcttttctccttaaaaagtatcagtgagggcagggaaagggaaggagaatggacccaaactaataaaaggattgatcagtgattatgaacaaaatatagcttctgtatttccactcactcagtatgaagtttgctattattttccccaattcctggagccagttattgcagcaaatttagcatttggagcttatagactcatgctagacagacacatatagaatttacgaatcgaattagaaaaatggtctttgaataatataaattgtactccatgtatatttttatatatgaatgaacctactggactccagtgagattagcaaataccttagctatttcattgcaataaaaaccatttttcagtcactcatgtccctctgggttcttcagtgatattatttgatgtatgctttattctgtgccatttattgtactgagtattttgcatgaatgatcttatgtaatcatcagtaatctgttaaatcagtatcattattattcttgtttcattgatattgaaatataaaagtaggttatcataaattaaaaggctacgggtagtgataaaattttattccaggtagtatctccagaatatgaattcttaatcactactcgtgtttattcattccacatgtcactgaatgcctactatgtctagcaaagttctagattctcttgtagttgcattactcagttattggctagataaccctaaacactgcagaaagctgcactctgcccccttgggattgcctggctccataagattattaccgttgctgagtttggggacccacttgagcaaatctagcatacttaaaaggaagtttttattctggagaagttttgttaacaaaacatctattggctgggcagagtggctcataactgtaatctcagcacttcgggatgccaaagtgggcaaatcacctgaggtcagaagtttgagaccagcctggccaacatggtgaaaccctgtctctactaaaaacacaaaaaaattaggtaggtatggtggtgcacgcctgtaatcccagctattcaggaggctgaggcaggacaatcacttgaaccggggagacagaggttgcagtgagccgagattgtgccactgccctccagcctgggcaacaaagtgagactctatctcaaaacacaaacatacacacatacatacagacccacacacacatacagacacacacacacacgtctatttagcatctgtcccaggcagtgcttctcaatagcatgttaatagatgctaaaggacctttagttaggaggtcaactggtctacctctgtcacttagtagacaagaaggttgccctaaaatatacactaagacagtatgcattacaaaaaagccacaataaggacatagcttaggagaaatgttatgatctctcttcaccagtctccttatatgacactggttcaattcagaagtagaggtgaagatagttaatatcctaggaataaatgttaaatctcccttcccctttcctcacagtattatagtcaattctcataaggaaatggccctaagttacaacattaagcttttctattcacttctaataactgaaattccgcccaactgcctcctcacttgaattccatgtactttttttccaaataaattaaatgactttctctaagtcaaatgctattaaaattcttgttgttcctcaaactctgctttcttgtagtatcaggtttattgtgacttgaatgagacttatttgtaaatggatgtattttccattccatcttgctcttgcatacacacacatacactgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataattagactttctggattttagatctattctcaagtatatattgtatagagaaccaagatgttcaaggactgtagagccagttataggtttggttttaaagcacttcatcttagactcatttcctttctggctgatgttagttaaaataatataagcctgggcttaagattgtatctctgagtgagacaaaataatagatgattctatctccctttagaaaaaaaagaaaaaaaaaaagcagcagcagcagtaattgactcttacgcttaggcaagaactccacaatggatttgttggggaaaaaaaaaatgttttcctgcttgtatgtgttggtttagattttctgttgtatgtgtgttgtgaaagaagactttggataattattgcgattttccaagcagctggtcttccaatggcattgttacagggtcagtctattttcctttaatctgaccataatgtcatagaacactggctgtttctttggcaactgttcagggaagactagctgttttctctacctcaagccaatggtggactgcaggcaggttctcctgcaagccacagggaagcagttttcattactggggtctttgtatcaacaaatcacttatttcactgtgattctgttgagacaggatccgaaagtaaatttcataagaaaaaaatgattatacatcaagctcaggtgactttaaaatttttcctttacattgagtaaagtttctggccacttttgaccttttttttcaaatgacattattgatatgaaatcagaaactataactgataaactacaaactgctgtatagacacttttctacacaatggtcattgcttttattctttatctaagcctgaattgtaaggcttccttctctttttttttttttttttttttgagatggagtctcgctctgtcgcccaggctggagtgcggtggcacgatcttggctcactccaagctccacctcccgggttcacaccattctcatgcctcagcctcccgagtagctgggactacaggcgcccaccaccatgcccggctaattttttatatttttagtagagacggagtttcaccatgttagccaggatggtcttgatctcctgacctggtgatccacctgccttggcctcccaaagtgctgggattacaggcgtgagccaccatgcccggcctgaatgattccttctcatcttctgggaggtttttctgacttgctttctcaattccactctcttaggcagagcttatacctcccttcatgtatgttacatgtacatgtattgagtcagtgcatcctcctaatgaaacttttcctgagatctctcttatttactttcttccttttctgaaattctctgctatttagattcagtgccaaagaaattgacatttttatttacttgctgaggaataaacagaactcgaaaggatttgggaacccaagaccaagttttatgaaataactaatcttgtcttcctaaatactataaaaatcttatataatccctaatacttagcatagtgctaagcaccgaataggaatacaagaaatattgcaatgatctgaattgcttacaaaatattgacaacaacttcttcattggtaaagaaaagctgcttttgacctttttttcttcctcaagagtaagtagtgagaagcataaagtacccaagagtttctttgcctttttgattgttgcatggaaacaagtatttgcaaataattaagatgggaaaatttggctccttgaaaaggcaggactgctttcagatatatttgaaatgaacttatacagaagccaacatggttatcagagcaattgggtctatttcctatcatctcttcatgatatcttgtaaaaatgccctgtgttgagagcactggtgatcatagcagtggggttggagtagaatctggtgcgtttcttcctctacagatctcctaatagcacttgccctgttttcacagagccttatcaaagtttgatgtagactccagtgtgtagtagtgggcagtgacctaccagatgacctctttgaacaagagctagtttgagccagtgtatagctctgaatcgatggaagatccattttcaaatttcaaaagggctgttaaaacacttagttctgtattatagagatacacaaatggatataacaaactggatgtctcttctgcagctgtttcaattcgtatgccatgttttctatccttcttgctcctggcaattttctttcctgaagcatatcacaccttcttacatttgacaagcattttcacagctactgccactccctgctgccaaacaaaacccagccctgtttgaattcttgagggctgagggatggagaggagacctgtttgactttgaaatggttttaacgtcactttgtatacagaacaaaaatggaaaaccagatcctgtgtttgtctaaaaactaaaatttcaaaacctaacctgaggtggagaaacagatactacagggcaaggaaatgtctgggctcaccgcaaaggaatgcagcaagggaaccacctgcagacacctgtttaagagtttacgtttttgttcttccacacgattattatcttagtatctcaactggctatacatgcttttaggaaagttgcagggatcatattctaaggcgtatcaaatatgttcagagtgcaagcatgagcagaatctctcctctctgctagtgaggtcctgtaggtctacaagttactaacttcaggcttacagaatgttagaagtaacgggtgcatatcctgtaatcaatcccggtattgagcaaacaggcacaaatgacacccagcaagaaaaatgacttgctcaagacaccacagcaagttcatggttttctgaactgaattccaagtttcataacttctaattaatcctcctttttttcccccagtacagctaatatgctttttgtgaataataacatataataggtgtaatctgtcagaactatttaatagttgatagtatgtatcctcagtttattgaggttcaagctcttctgagtattataatactttctattggtattttctctcttgagctattccctaccttgaatctttcagactagagatttcagaagattacgtagtgtctgtgacttcaactacacatggatagtccacaggactctggactttcacggttccatgtcagttggacaggtgttactctaaggccctgcaaaaatataaagtagtttgagaatcactctcctgttaatcttcagtaaaattctgagctatttatatgtgagattgagaggcagcttggtaggatggaaagagtttagactttgtagttctactgccccaggtttgtatcccagctttatttcctaacagtgtagccttgggcaaattgcttaacctctccgaggctcagtttcttcaaataaaaaaatggaataagccttcccttgcagagttgttaatattatatgaacgttatatatgtgaagtgcccaactccttgcaaatacctaatatacaccagcttccttcccaggcttttgctggtcagatctggtttccacttaactttggctgttggaagataagataatttattatgaagataattgtctggtaattgtcatgagaattcagttgatgataattgaatgatttgtttacctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggattttgaagacggagtatgatctttgacagatggtgttcggtgggaatgaggaaaaagaaaggtgagcttcagccagggattggaggtggaaaaaatgaacacatgggtggcgatgattcaggcagaggggcaggaatgtgaaggaactaagacataaaagtagaaagacagtttaggcctggtttatgagggggtctttgaatggcaaactcacctttggtggtccacgggaaggtttgttagaactgcaggagtgtgcccaaacctatatgtcaagccactaactgccagccatcagtttgaaaaccgaagcaattaagatcgctgtccatcttacctgaaagggaagctttgcactctaacttgaagtagcctagaaatttcagaaggttacatagtgtctgtgacttcagctacacatggataatccacaagactctggacttattttcactgttgtgtaatagggttagttttgtttttagcagattctcccaaggaagtgtggtaatcacatttctcaaaccattacattaactgctgttagcaataaattattgcttatgtgctaaaagtcaaaaaaagcttttcccctttggaacttctttactatactccctgatatgttttgctgtcctagaaactggtgtttgtgtgtgtgtgtttgtgtgtgtatgtgtgtgtgtgtgtgttcaattgagtcaagaacagaggagaggagactcaggctgaaaatgtcaagttattttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatcccaacttaatttcctaaatctgtcctatctacataccacaaagtgcttaactgagaaattaacttctgtgttacagataaatggaagttagattaaaaggataatacattttcatttttagtgttcttaaataatcctttttattgtaaataaatataacgttaactccgataagtccagactacttcactgagttcaccaccgaaatgttttcacaaaatcagcatcgttataccttggcttttataagaagttagtatacgaaacttgtataggaaaatgtctctgtattatctatgaaactgttaataaatatgttttccatcatgtccatgtcatcgtttacatatacgagatgatttcctcttagaattcattctaaacttctttaacagaaattatctttttttgattcatattctcccttttgtcctggttaccagacagcacaagtgaccatcatgtttagatttctgatacagttctctcttccattcctctctgtagcctctgatttttttttcagacttcagttggaaaaatcctaatgaatgtaacttttagttacaggttgaattcttttgaatgtgtatatttaaaataagtaatgcacatagttaaaaagaaacatgtttttaaaacagtggttctcaattatagctaaatatttagaattatctggatggttttaaaactctgatacccaggcagcatcctagatcactcaaatcagaatatctgggtttggtcacggacatcagtattttttttttaaagctgcccaatgtcattccaatgttaagattcattgttttagatattctttattatgatgttcatcatttttacagaaacacatttccaaaaggataaatttcaaaatcacctgtaaacccataatttattataagtcactcttaacacctaaaaatagctaacctgctaacctttttcttttgctttttccttcttcttttaaactaaaattacaataatatatgtgcatatatagtgaatgtattcatttatatattagacacaatttacatatttatgcttatatatatatggcatacatgtacacgttacaatatgtgtatttgttttattccaaatctgttttattctcagagacattttcccatatcttcccagatatattttctgagaacctggtttttaatgcttgtataacattaatacttgtagttagaccattttttttactcattcttctattcttacatattaatgttgcagacaacatccttaaacaacttttgtgtgactaatccaatttttttccttgggaataaattatgatctattgatttatttctatgtgggctgaattttgtccataagaatgaaaatggtagccccctaagatgctgtttgctccctgatatctcatttttctctagaatacgaaggaatggctgttttctgctcttcctaaagattcaggatgtaataatatactgtcacaggtttcagaagcatgggaccttggcaccgaaagggtctctactagctaagttgtcttggaaatgagtgggtccacttcctcttctgatacaggaagaacagggaggtcattaaatgatgacggggctctttgaagtgaaatgaagcaacattggagggtgtagcatgtaaaaactctcttctcggatacaaaaaaaattgagctacttgggctaggagaagtgagcctggatttggaggcttaaggtttcaggaaggtctgagacaaacttaagaagaaatgcatcaagagggttggaagggacagacgattgatgagagcactgaaattccagtgtgatttgggtcacccgtgtgacatggcatatatttatgggatacctggaaaataagggagaaacaagacatctatctctgtcacactttggggaagtatacgattaagttccacactctgtggtggaaagaatgtcctggaggcccccagtctttctcactgtgatgccatgctcatttgataacctcataaacacatttctgttcttattgccttacccattctgatgcactgatcattttttaggccatgtgaacagggcagagcttgtcattatgcctgggacatagtgggcattcagtaggtgtttgttgaatggaagaagcaggcacaatcacagctttcccttctggtgatctgctttatgatacaatttccaggaatgcattgtgtctaaaattggggaccatatgtacaggaaattctttcttatgtcagtgtgaaatccctccaaagtaaatccccctttatggttttttattggtgtttattcttttttaatacagaaaactgtaaactttttattagggcaggtttttttgtgcaaaagccttgtcatgggctagatgacatttcttttcctgtagagatacttggacattttataattcaattacttccttccaaaagccatatttagaattccagccaatctgtgagccagaaaggagtgagccagtataataatcaaggtaatgtggcaagaaggtgtgaaatttcttagcctttctagaagagatgggtgaaaataaatgttttcagggtcagtaaataactttcccctagtagccagacagaaagcatcttactttgctcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtgagagagtaatggaatgtgtatgtctctgctcttgaagataccaggggcacctcgaaaactcccctccccagcccagggtcaccacagccttaaccgactgcctcctttgcaaacctttaccatgggtacctagaaaaagacatacacacacacatttcagcttatggtttttgttcgtttgtttttgttttttgtttgtttgtttgttttgccagatacttaagatttaagggcaatcttaagggaaatctcttctcccatcttgactgaggcacagagatgtcctgttcccatgctgttgatgctgacagacgtaggacacgtttttttctccgtgtgccaccacactcaagcagaatgtataagatattttctgtctaccaaggatacctggtgacataatcatacctagcctttctttcctccctccgccccctcagcctctcaccctgccctcccatgggtctttatgtgtgctactctatgtagagtacaactcataccggatagcctgttacttattttggttcaggagcagctgcagaggatgaactggagaggacagtctacttgcaaacacttgtagactctccagtggacaggttacctctaaagaaagagaagcctacgctttcctactcactgaagttttttaccatttgcaagtggatccaatatatgtttgttttgggtgaggggctaacaaaatgctctgcggtttctgcaggtttccttataggagatcctgttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgatgataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatggattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacagggagtggaacagagagacagaaaatattgggagtcttgtgccccatcagtagaaggagatgaaggccagagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactgtgtcctaggcaccactttagttcttgagtggtcagcagtaaagaaaacagacaaaaaaataataccctggtggagtttccattctagtggggacacaataaacaaaataattggcaaattatatagaatattggaaggaagtacatgctgggagagaaataagctgggagggaaaagggagtgctgggggagaaggagctaagagtctcagttccagagttaggcagcctgagctggaattagaaccccagctgcatgcagtggctcatgcctgtaatcccagcactttgggaggccgaggtgggcggatcacctgaggtcaggagtttgagactaccctggccaacatggtgaaacccagtctctactaaaaatacaaaaaaaaaaaaaaattagctgggcatggtggcgggcacctgtaatcctagctacttgggaggctgaggcaggagaattgcttgaactcgggaggtggaggtttcagagagcagagatcacgccattgcactctagcctggcaacaagagcgaaactctgtctcaaaaaaaaaaaaaaaaaaaaaaaaaactcagctgcatccttcccagtcatgtgacctgggcaggttaagagaactccctgagcctcagttttcttgtctgtttatcaagagtcattagggaaactagtatctccttgggttgttgcagggattcaatgagatgacacatgtaacacaatcattacctcgggcctgtctcctataaatatagtgattgtcacgtttgttatttaaacaatattatatattgtgttttaggtattatgtatgtaatatatagtgtgaatatatgtatgcgttatgtatatagcattatctgacttcgtgcctctagtattacatgcttctcaaaatatctatagttttgtcggtatttctttctcctactagattgtgatcttttatcggcaaagaccacctctcatttatctctataccccccattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagttgcatgttactaataaggaatcagaagctcagagagggggaatgaaagaatccaagtatatgtggctaaaattggccacgtcgacacctgaaatcctattatctggggcaatatacatactgggtttgaaaaagttcacacttagcagttgaatgacctgagtcctcaccccagcttggctacttactcaccatgtgaccctgaatagtgccttgaagcctcagggtttttttacttctgtaaaacagtaactcttgccctcccggacacatgggatagtttgaagattaaaagatacattggctgggcatggtggctcacatctataatcctagcactttgagagactgaggcaggtggatcacttcagtccaggagtttcagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattgattgtaaagaatatagaatgcggaaactcatttttaattattaaaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcgcttgaacctgggaggcagaggttgcagtgagccaagattgcaccactgcactccagcctgggcaacagagtgaaactccgtctcaaaaaacaaaaaaaaaaatgcttccccacacccacccccaacgaacgaacaaacacacttaggaaatagggaagaaggttatgttttgggacaactttctatacactgagaaaatccaagaggtctccacatctacctataaaattcagtgatgctcagagctgacatgtcaatttttcctattacatagtaagaagctcagcattatgggccgagtttattggacactgcagaaattcatttacattgtgtgcttaccctggattgttgttgagtccagctgactgttgcttcacaaattaactgtcctttgagacttggaaatattgaaattgcatagagtttttgtgaaatctcaatcctgtagtattgtgtatattacaacaggtgctcaatagacttctggattattaaattgagtaatatttgtagcaaagatctgtaggctgaattataaagctaatctgtggggggatgccaagatttctctatcattctgctatgtttgccatggtctaccaggagatggcgcctggtaagagttccatattttaatgtattctggtccaaatcactggagttggcaaagatggagaaggaggaactgagcagttcatccccaaagacatgatgacaccactataagtgtgaagccagcaagagtgcaaagactgagagcagcgtggtcatacctagacatttatctggagagcaaaatcaagcactggggctcaaagggttcagtcccagcagttaggagagagaggagtctcctaggagtagttgccccaacagctgctagaaagtcctgatcctttttggtctgagccaaccaggtctcagcccagtcccacttgcctcaatttaaagtgacatttttggtctctagctgggtgcttccccctctgtagcatataacaaggatacactttcaaggcagggagcctggaggacaaggagataaccctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgctataccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgttggggtgtaacttaccatgattacatgttgtgatatacgagtccatctcagcagatagagagactctccttgacagcttgaggaaataagtgaccatatgagagaagctcatgaggcaaggagctgtgagcaacctttaggagctaaggacagcttccagcagacagccaacaaaaagctaggatcctgactcacatacccacaaggaaatgaattccgccaataatctgaatgtgcctggaaaagattcttccacagccaaccctccagatgagaatgctactcagctgacactttgattgcagcctgtaagactccgagtggaggacccagccagagtcatgcctgggccctcagaaactgtgagatagtaaatgtttgttgttttatgccactgagattgttagccaacaatcaaaacctaatacaataataccctttactgttttctagacagctgctatttagaaaagcctcccacccaataaaagagtcccctttatagttttccaagtaggtggttatcagggttctgcttcaccatcttcagtggcaaggaacttccatttcacagggcaaccatgtgtgtattacagaggcttgcatgttgtcaagttcagctgtggtcttcagcgggagcctaggacatgccagggatttcaaggtaggctggtgaggggttcctggttttcttggtcctgaaccatcccagtgccattctaacagttgcaagtctgcctccttcatgacaaaaggactggaggaaaatgtatctggcaagtcgataacactggatcgtttgctcccagctttaccacttggcatcagtgcaaactttcacccagttaaataacttaatgagccctgctctgcatgcttgcttcacagagttgtgacgatcaagtaagacagcatctatgacagtgtttgttggctgtaagtcagcaaatgattgcaaatgatgattattattaaaataatagtcatttgtcagtaaatatttgtcaaagctggtccacactgagggagacaggctctccagggaaactgctgatgcagagataaagaggagaccagccccagtttggaattgcatcactgattctgaattccccatggtacatttcaggtcttgcttcaggaatttgttttttgttttgtttggtaggaacaagaatcccctagagccagttatgttgtcatcaaacttagttgctaattaggcaccaaagcaaacctatgccagtgagacagagttgaaacttgaattcctttctgcaggtggagcgttggatcctagaggcggtgtatacagcttggctattttgatgcttctgcatgcaagaaggtttaagagaatctgagtaaagcaattagcatccctctgtctgcaggcaaaactggtttggacatgcttctctcttcttgaagggctgttagagccttggcagtgtatctgacgaaagatttcactaagcaaaatgtcttcacttacaaatccagccactttgcactctcagtcagcctcaaattcatttattttctttagagtttccctacaaccacgaaccaccaagaattaaattaatccccaagagcctgagcaattatgaggatgttgaatctatccattcaaggatgtcccagcaaggactgttcattcttttaacgtaaactatttatatgttttgattctcctcatttggaagaaagaaataagttttcatatatgtatttttcagggtgtattttatatatctgtttatattacactgttcacattactattaaagcatccccattttattgtaagtttattttgcctgcttcgggaagaacaagaccaagatcccattattaaaaccaaaatcttccacaaaagtttccttttaaaaacttagattaggaaattttcagtcagccagccaactctatagcctttgatacttggtcctacaaagttttcttcccctttggtctgaatgttttcctttgtctgtgcacactctattctcctgccagcatgataatacatgctgctttgatatcaagtggcgggaacatatagaaatgtgctattggtgctgcaatttgtatctttgttttcatcaaacttattatttaccattttaggatttttttgtttctttttgggtgtttttttttttttttttttttttggtgtgttttgtttgatcttggttttggttttccaatctaggcctgaggtccagtgctaatttgatgctagtgtgaactctctgagcctggttccttgacgttccattgggtgactattgcagtggttcagatgtggtgctaccagccttccccaccaaggaagttgcctgctttctcatctttgatcctcttcaccaactaaccacaacacaccagtgaaaattttaatttctccattcagttcctcagtttccgccaccaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagacccatatatcaattatttgcatccttcaattaacccacaagaaggcaaatttaatccagtgttagataaaataattattcacagggtcataacactattaaagaataagctatggccaggcgcggtggctcactcctgtaatcctagcattttggaggccgaggggggcagatcacttgaggtcaggagttctagactaccctagccaatatggtgaaaactgtctctactaaaaatacaaaaaaaaaaaaaaaaatcagctgggcatggtggcagacgcctgtaatcccagctactcaggagctgtagtcctagcattttgggaggctgaggcgggcggatcacttgactaccctggccaacatggtgaaacctcatcctactaaaaatacaaaaaaaaaaaaaatcagctggtggtggtggcagatgcctgtaatcctagctactcgggaggcggaggcaggagaatcactcgaacccgggaggtggaggttacagtgagccaaaattgcaccattgcactccagcctaggtgacagagtgaggctccatctccaaaaaaaataaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccattcttacctaacagggaagctgtccataaataaggtagcaattcctgaatcaaggacaagccttctgcccagtctttatatgtaaagaaacagtagtttcatttgaagggaaaccattataattgtctcagatgtgcatcttgttccagggtacttctttgtatttttgatgaggaaccaaaggctttattatagatcttgtgaatacctgtcagccaggatttagaacaaatgcatttgggcaattttgccttttatttcagataaattttatatgttgtttctgtccagaattgtaggatcatgtttggcttttcaaaactgcaggaaatgtttattttacttttctttaaagaagaagacagtaatgaaaaatgtatcgactgccagcccactgtttttatttctctttgtgtgagctatggcttctccacatcttgagccttaaactctttgatgttgtctttttaagcataacataaaagattattccctttagtctgtaggcttggaggtgggcaaacatgacatattcctgggtattcatatttctataacaataattgatgcaggttttggggctgttgtatttgccgtagccttatatgataaacatttggcattccatgacgtttcagctttgtcaactttccaatcctgtatggagttccctcttattgtttctgtgtgaacaacttgacaagagtggcatccgtggtcagattcttcactctatccctgcaggacttttcattgtgctctgcacacgatggaggctcaatgcatgaatgaatgcatggatgaatttttcagtttgattccgtgagctgcttaattctattagatgcgctccctaggcttttataagacgtttaattggtacatgtttcttatcactttttaatactccataagtgttttgtgttctttgcagtagagtccaaataaatataaattaaaatgtttccaattacagaggaaatattttcagtatcttcccacaaataacactgggtttataaggcttggttcccgggtttcatggtcatgcttggttgactaactttgtgttcatgtggcataagattctaaactgtcagaactacgtgggcttttagagcccatctaaatccttctcactcacagacgagcaagctgacatatttgcctcatttattggcagtgaatgaattaaaatattgtgccttcatcaagatattgtgtgtatattcacaatgttgtttttcataaatatgtagcattactctgttttgtgactgctcctagactggctggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacataataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccagaatcttttccacctttgagattattttaaatatcatcattactttgagaaaagcaaacttaacaaggatgccttaagaaatataaaggtgtcattgcccaggaggcaagaaagggaggcagaatggtaatgaaatgagacagcccttgctttggttttataagatctgggtctgaatcctggcagtgtgttctttctaactttaggtaattcaggagccctagaaacctcatctctctatctagtgtgggaaaacgtgaaacaactttgggccatagattgctctatgcaaactcaacatatgcaaacttgtcttattaaaaagcctatctctagtggttcctatccctagtcttgtttggttgggtagcttccaattaataacagcttcaaattctggctaatatttgtttagcacttcatggcttacaaagtacttcattattttaacattgtagtattggtaataatatcaaactttctgttattacaataaatgttccttttttactttattattccattactttattactgtttttcagatgtactgtgatctacattttacggatgaaaaaaagattctaggaggataagggactttgtcacaaaagttagcttctaaatgatggggggactcatatgcaccttttgaaactcctaaacccatgttgattccccaaaggctttggtggtcctaaacatttgacataatcagagtctattataaaaaggtatggcttatccagctcctggttcctcactgtctcctctatctcaaaatattctagaaaaaactttactccctgaaaatatacagctttaggataggtgcagctccatttcatactctgattttcattcctcatttgaaaagttgaagcgtaatttcttataagactttagaagttgaagtcaggactggataaagaaaatgtggcacatacacgccatggaatactatgcagccataaaaagggatgagttcatgtccttttcagggacatggatgaagctagaagccatcatcctcagcaaactaacacaggaacagaaaaccaaacaccacatgttctcactcagaagtgagagttgaacaatgaaaacacatggacacagggaggggaacatcacatactgggtggggcctgtcgtgggggtcgggtgcaaggagaaggagaggattaggacaaatatctaatgcatgtggatcttaaaacctagatgacaggttgatgggtggagcaaaccaccatggcacatgtatacctatgtaacaaacctgtacattctgcacatgtatctcaaaagtaaaattttttaaaataagaagaagttgaagtcagggtataggaatcacaatttgcagtgctatctttcacacttcttaccacctgatgaaaatcaccaaatagtatttcttcttttacctaacatctctaggaaagagagaaccctgactgcacctacaagtagggaaaggcatttgagttacgcaaagctgcttttaactctgaaactgtcctacagtgtagcatataaacagggaaaacattttattggtgttttaatagaatcttatctaaatatctggaatcttactgcaagggccgatcattactctaggtagatttcaaggcccacagctccattatgatgtcaacaaggataactgatgtttattctgtagttagagcccccaaggcttcagcaaacattttgctcatcacttgtaggactagcagtaaatgtaatcattgcaagactgagctaacacatctgctaacagggttgttcatttgagtaaacagcaaggtgataaggcgcagggacggaccattggattgagtcagacaggcccgagtacaaaaaccagcctcactacttaaatcttacatagcccattaagagtaagttgcttcactttgggaggctgaggcggacagattacgaagtcaggagatcgagaccatcctggccaacatggttaaacctcatctctattaaaaaaaaaatacaaaaattaactgggcatggtggtgggcgcctgtaatctcagctactcaggaggctgagggaggagaatcccttgaaccagggagtcggaggttgcagtgagccgagatcactccactgcactccagcctggcgacagagtgagactccgtctcaaaaataaaataaaattaaattaaattaaatttaaaaaagagtaagttgctcaactttttaaactttagttttattatccacaaataataaattataaattgctgctttacatatatgatataaaaatgcatcaatccagttaatttggggtaaatggtattattccagtcttacctcctagaatactcagaagacacaacggtgtatcactagaaggagatagttttgttttggtttggtttggtttcttcagtcttctttttcctattccttccttttccaagaaacccacgatttctttctttctttttccagctattgatgaggtcagggagtaatatgttcagatctttgttgtatctttgttccgtttagaaaccagtatctgggaattcaacagagaatttggggtcactggaagctatgttttacctacatacaactacatcttcctcttagacctagagactagatactgaaaatgcaaaaggaagccatattgacactcccaaggataagggaaggcattacatcatcctttgtaatggtgaatcttgtgcatttgtagagggctggactttggcttctaccatattgtttagctctgtcaaccccacacaaggactttatttatttatttagacagagtcttgctctctttcccgggctggagtgcagtggtgcaatcatggatcactgcagccttaacatcctgggctcaagtgatccttccacctcagcctctcaagtaactagcaacacaggtatgtgccacctcatctgactaatttctttttaattttatatagatgggatctcattatgttgcccagcctggttttgaactcctggccacaagcattattattatcctcatcttacacatgaggaaactaccagtgaagtggcttgcccatcatgtgaaattacatatgccagtactagcctgttctgaaatccagcaacattcttttccacctctagccttgtttctagcaccctttggcctccagagcaagctggggttcattttacattaaaagtagagccatctgatgtggcgggcatccaaaacacttgggaaaatgctactctgtttagaactcgcttttcttcctcccgggtcccagtgcaggaggtactgtgtgctatgtgggccatcagactgtccctggccatggcaggagaattaggagaccaccagggctgtagttaactgtaggtccttcattaagaccagccaattgatagcgtgtgttcatgagtccttgtgaagtcttttcatcagccacgtggaagaccccttagaaaaacaatctctgtaatttgtatttttggacatagtgctttaggaaggtggatgtctgaaggtgggctgggtttgaaacatctctcaatgccatgggacagtgtggtacagtgtcctgacaacttaagctcatcctgacaacttaagacactaaattctactcctgcctcttctagtctagttggtcacctgccctttctgaatttgtttttttttttttttttgagatggagtcacgctctgtcaccaagctggagtgcagtggcacgatctcggctcactgcaacctctgcctcccaggttcaagcgattctcctgcctcagcttcccaagtagctgggattacaggtgtgcaacaccacgcccagctaatttttgtattttcagtagagatggggtttcaccatcttggccaggatggtctctatctcttgactttgtgatccgcccaccttgggccactgcgcccagccctgaatttgttttcttaactacccatttatttgcttgaaacagatgacttaaaatattccttcctcctctgaagttgttctttaaacttttctatgtaagaaattgattgagctgtattcctaggtattttattctctttgtagcaattgtgaatgagagtttactcatgacttggctctccttttgtctattattgatgtataggaatgcttgtgatttttgcatattgattttgtacgctgagactttgctgaagttacccaccagcttaaggagattttgggctgagacgatggggttttctaaatagacaatcgggtcatctgcaaacagagacaattagacttcctctctttctatttgaataccctttatttgtttctcttgcccgattgcactggccagaacttccaatactgtgttgaataggagtggtgagagagggctaatttacattcccaccaccagtgtacaagggttcccttttctccacatcctcatttgttttttccagaagacagcatttgctattacctgtcttttggataaaagccattttaactgaggcaaaatgatatctgattgtagttttaatttgcatatctctgatgagcaatgatgttaagcagcttttcatatgcctatttgccatttgtatgtcttttgagaaatatctatccatatttttcgcccaattttacatcagattcttagattattttcctatagagttgtttgaactccttatatattctggttattaatctcttgtcaaatggatagtttgtaaatatgtttccctttcactggtttttgtcttcattttgtttgtttcctttgctgtgcagattaacttgatgtgatcccaattatgcatgtttgctttggttgcctgtgtttgtggggtgttactcaagaaatctttgcccaatccaaagaacattcatctttgtcaaatgagctatagaattaatgtttttcctatttttatttattcattttatatttatttctattttatatattcatataacaatatatttattcataatatcactttgaatatcatttgttttcatcttgcatttttctcatttttcattgaggcctaatttacatgcaatgagatactcagatcatgagtcgtagttttaggagatttggcaattgtatatattacccaagaaagttcccttaagttcccttattcctctttctattcaagtcccatctgccaccctcagaggcaatgactttctgacctctatcaccagaaattatttctatatgttcttttaaatcagataagaatcacaccatatttattttttgtatctggattctttcattttgtgcagttgtctgagattcatccatgttgttgtattagcagtcttcatctttttgttgtttagtatgccacgattataccataattaatttacccatttttcttttttatcataatcttatataagggaaaaacatgggaatacatgaactgtatctttggctcaaatccatcttctatcagttctaagggcctcagggtatttgccatgaggggctgtgacaccagcctggactattaggaatggacctttgcttctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccctctctttagcatttctgtgaggaagtatccaaagcattggattacttgagataatatttctggtcctcttcctctctcacactctacactttgcttttctagaattgaagcctggagaagaaatattgtctaaagagcttgctacaagaaaatttccctaaaaagtattgggtcttaaaatttcatctcattttcaagttcttagaatactgttaatttgcaaagctgattatggatggcatactttattatgctttttaatcatacttcaaaactgcactatggatttgttctttctgtcttcctcccatgcttaatcattatttttggtggcaccttctaaactgttgacttattttctttctttctgatttgtagtagatgttgtataatctaagtttaggcagagatagtgaaagtgctggcctgcctgtatttcagccagtcctgggttaatattattcatgtggcaatgtctgttttactttaggactcaacgtatttaatacttcctctcctcctctttacaatacatagaggaaaggcctttgaaacataatttctctccctatgggaaatgctttctataaatttttcattttcaatacaaactgcttcactttacaaaacagtatctgtccctagcatgaaaaaatactggagggatatgaacagtaaaggagaatatttttctagcttgtgttaaatcaataatgtagtgattccaagggaattgagaggttcgtgtatttattcatatattagtcaaaaattcaaaattctatctctaattaaaaaggaatttgagaagtatctaccatttttattgtccatctctttggacatatgctttgcagcacagtggagcggaaggagcgtagacctacagaaatttagagggctaaatttttaatattggcctggctacattgcctggactttgggaaaatcacttaagctctcttagccttagtctttttatctgtaaactgagaataataatgccagtttttcaaggttgcattgaggatcttaggtaatacatataacattcatggaacataaaatgtgaaccaatgaaggtgccaatgcaattacaccttcattaggagttgtcatttctgcggcttctcattagaacatcaaaattagttccttcaatctttactgaggcgcagagctttaaactctaactttgaaacttccaaaatgaagtgtgaaaggtctgaggccttgtgagtttgaaaatgcagttcacacttcattttagaagctccagaattttttaccaaattgagattggattcaggaaatcatattttaaagccctggttcatgccattttctaaagaagtacctagaaggccataatcagaatgcttattaagtgaccacactttgaactgcattgcagataaattacctctgtgtggggagatgtgtcttgagattctgcggtcaaggctcagacagccccagagctggaaacctcagagcatttatgcctctgtcactaaaggatggggttatgggggctggacagaaagcttgagagagatgaaaagttcagtgggcttgagggaggattactgaattacaataatatccacaccgtaaagtgaatttgtacttgcaagagacacattatttatctagaattttagaaagggtctcttttcaggtcactgtgtagattgcctgtgatttgttctccttgattgaatgtgagtgagtgtgaagcatatctaaacaggtctcacagcaagtttctttcataaatctcctctggtatatatgctgtgtacccttgacaaggagaacactattaatggcgacagtatgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcgaggctttgtctttgtcttctaagcttgctttcccctgtgatgtccagtctctcctaaaccagataaggattcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccgtctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgacagagcaagattccatctcaaaaaaaaaaaaaaaaaaaagagagagaaaagaaaagttacatgtagagaactgtaagtaatcttatctggctagaatatagggtaccataggggaatgactgagcatgggtcagagttgtaaacatccttatcatgccaatgagttggatttctccagaaggcatagagagatctgtttatagtttctaggtaagaaagagtttatgaacttgcctgtgtcttcgaaatatgctgtggcagaatagaaaaggtgatcaaccagagtaggacagaggccacacacatctgccctgaggtcagatacctatacatttattgtgtttgatagccaaatgattttaatgtaaactagttgcaaacatttaaaatttgggaaattttacataaaaatctagattttcgagcttctattaagaagtagagtgcacaatatctgcctagcaagaaacagctgttgctgagaagtgtcttccaccttcagctagagcatgcagtctgacatttgcttttctggttcttgtatttgagtgtgagactcttggagtaaagcaaacccagggtcagaaagatcactggtgatgatgttgcagttgtactgtcaggactgatgaaaacctaaactaaggtggaagccttgaggaatgaagaggagggcaaggatggatttgctgattgtttagatgtgtcatggatgaaagagatggagaaatcaaagaagactctcaggttgtaattttaggtaactgggtaggattcccatgtagtcagaaacccagaaagaagagaaggctttgggaagatgacagtgtattcaatgtggctttttgtggttcaagactttggaaaatattgattagactgttgaaaagtacttataggtcaggaacctggtcagaaagtattgtgctaaaataatattgttatgacccaagcagttgtaaaaataacttttattgtctaactctcacagtttatcttgaactcttaacaggttgtcaggcaaatatctgttcttgaaaccagaaaaacaaatcaagaaattgggatatttgaaatgcctagagtgggcttataactgtaaatgatattttacaatggaaaagtagaaacagtctttagcagccaatgtgaaataactgggtaatgttatttaatagaatgcaaatttgaaatgagtgataaccattatggagaattttgttaggaaaaaaattaataaagtgaatgtaacacatgaagcagagctggaactaggaagaaggaagtcaggctcctggggaaccaaattaaggagacttcccctctcaggcacttgtgggaccctgacggtaagcatctccttaggtactgctcccatcctcatccttgccttgagtttttgaaaaatatatgttagaaatgtttatgattatatatcacaaactgttattctcaattttatgaaattccctagatatgattacaatagtcatttgagatttatgatcttatctaattgttatgtatgtacccattgtggggtgatacaggcagaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactatttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgcctagcatgcgaccactgtggagtgatgccagacggctgtgccattccagtgcactgaggacggagggacccttttcctctgaggacacatcatttcaccttaacccctttggccagaacaaagttgcatagctgcaaggacgactgggaaatatatttattctgggcagccatgtacttagctacaatttggaggttctaaagaaagaaaggaagagaatggaaacaattttcaaggcctaccacagcaaattggtgccatttctaggactagtatcctatttcctaactcctagtagaatgttttttctataccacagatttttaattctcataaagatgtgatttttaattaagaagcctataagaacattttgaatatgcacaaattcatcattttatatgtccatacgggatgcagtgattcccctttgcttaagatcaatttttgtttttattaatcccttgatatatagataggagtcaggcagacccaagtttaatttctgtctaccaacttgtgactttgggtccatatgaataaaaaaatctatgctttgattttgttttttcctctctaaaatagtaacaacatgtcatcttggggttgttttaaaaattaaatgggatgatattaatgaaagagcctagcccagtgtttagtattgaataggtagatatctaatggtacagataccagtttccttctttctcctcacttccttaggttccctccaacctgaagacaacgtatgtttctcatagataattacaaggaatttaaatccttgacaaaatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcacttaggcaggtattgtgattatctaagtgagagatgatagaacaatatggcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatgagccaaactcaacaagataaaatctaagagggtcaagtcaaatttcattcttacctttaaaagttagctatacaagtacatcatataaatgtcatttactttgatagctgtttatattttttaaaaaaagaaagaaaacaagactggtagagaagatagtctgaccgcaagatcaacaataataataataatgtaggaccacagaaaagtaaatgaaatcttggactgcattcatctaaagaggagcatgcagaacagggaagcagcagtgcctggagtgctgagttcagttctgggcgccacatgatgaagggaacctggataaactagaccttgggcagacaaaggtgcttgggagagtgaggtgacagaaatttctcataaggaatgatggaaggtatccctttattccaataaaaagaagactaaggaaaggcaatgttttcagtgctctttagggctgttaaattgaaaaggcaacagatttgtctggagaggacagaagtagggccaatggggaagaagatatttatgtcaaaataagaaagctctaacaattagacctaccagtggaatgaacgaaccaagagagtgagctgtccctggacatggtataagcagcctcaggggctggaaaaacactgactgactgggaatgttgtagagggaatttatagatcagattgattggggaaaatagccccaaaggttctcctctctctgacatcactctatgattctatgtgaagttctagctttttaactatttttttgtataattaaataatttgtctttattgattgagaactaatcattaaaaaagctactgtcttttcatgtctagagatgataagaataatactacatgcttttgaagaaaaggaattttatgcaaataatcccataccagtgtattacgcttttgcagggataatcaagagcttgcaaaatttgaaaccacattttcccctgtatggaggaggaaagtctattttgcatccgtactttatgccttgggcattattattgctcatatgctctaggatttttaataaacctaacctgcttcatgaaattacactgcattaattcaacatggccatgtccaaaatttaatattcattcatttattcaagtatttattcaacaaacaatccctactatatttcatgtgctattgtcagtgctagaaacatcaatttaaaaatgtttaaatcctagtcttcgaagagtttataattaaatataaaaatattgtctatgtgtcaattactgtagctccaaatacctatttactccaaaaattagtgtctgaaaggaacaatcatttattatctcttacagtttggtgggtcagaaatttgatagcatcttgggccaggcgtggtggctcatgcctttaatcccggcacactgggaggctgaggcaggcagatcacttgaggccggggagttccagaccagcctggctgacatggcgaaaacctgtctctactaaaaatacaaaaattagccaggcatgatggcacgtgcttgtagtcccagctacttgggaggctgaggcatgagaatcacttgagcccaagaggcagaggttgcagtgagctgagatcatgccactgcactccagtctgggggacagagtgagactctgtctcaaaaaagacaaaaagaaagaaagaaatttgattgtgtctcaagtgggcaagtttggcttggggtctttcatgaggtttctggtgtgaggtctctcaaaggctgcttctccttacacctgggccaggagtgtttgaacagctagtctggaacaacttggggtcttcaggtatctccctctatctgcatgtggtctctccagctttgggataacctaacttcttacatggtaactgctatagtttgaatgtgtcctttaagttaatgtgttggaaacttaattcccaatgcaacagtgttgagaagtggggtataataagagatgattaggttatgagggctctccccttatgaatggattgatgccattattttggaagtaggttagttattgagagagtaggatgttataaagtgagtttgactccctcttgctctcttgctgtcatcctctcttgaccttctgccttctgccctggaatgacacagtatgaaggccctcaccagatgctggcaccatgatcttggacttcccaccctccattatcataaaccaagtaaatttatgttgttcaaaagtgacacagtcagtggtattgtattatagcaacacaaagcaaactaagatagcaactgaggacttcaaaggtatgtatttcaagagaaaactatatcacattttaagattagcattaggagggctgggtgtggtggctcactcctgtaaccccagcactttgggaggccaaggcaggtggatcacctgaggtcagcagttcgataccagcctggccaaacatggtgaaaccccatctctactaaaaatacagaaaaaaaaaattggtgagcacagtgtcgggcacctgtaatcccggctactcaggaggctgaggcaggagaatcgcttgaacccgggaagtggaggttgcagtgagccgagattgtgccagtgcactacagactgggcaaaaagagggagactctgtctcaaaaaaaaaaaaggttagcattagaagtcaggcagcatcactgctatgacattctcttggccaggcagttgcataggttctcccaagacctcacctcttagtggtggactgttagtatcacattgtgagatgggatgtgttttggtgtagtcatctttgaaaattacaacttgccatagcatatgaacagataacactatacttgggttctctgctatggtgctgtgaaagaacagaagaggagagtgattaacagaagaggtaacattcacatatcatgggccatataatttgatgtatgtaacttgttaaggaaatacgttcaaggcaggggcaacagcaggtggaaaggcatgaaagaacaatgagcacaaagtgtttaaaagcttgggttgacaggaacaaagactgagttgtaggagaggtgacaggctaggggcctagacaggggaggtaggacagcatcctgaagggccttgaacatcaagttaaaacgtttggctttggggagcagtcactgtctttagagcacaggcatataaactgatcgtctttggtaatctcttccatctacaatctttctttcctttgatagtaaacatatcatctctgttaaagttgcttcctagcttaaactgaacacagactccaaaccattgaagcactttagatttttttcttttttttttttccttttcttttactcaccacaaacaactctagaatggcatgcatttgaacaaaccaaaagtgatttcactcttctaattttcagtgctttttggctaaatgcagagtgagaaattcatacctttttcaagcagtgtgggttctttttcccaatttctgtcatccatctggttctctggaggtcttggaatccaggaaagtgttagttcactgtgctgaaatccaaaaaagactgctaaactgtgaaagaaaatttgcattccagagacactgaaagagttagtccaccacccttttgcaacagcaaggagaaaacatctgtatttcctgcctctttgtctttaagcagttatagaatggaaaaccctatactccctggctgtgcgtttcatacctagttaatctaaatcacttttggcagggtgggggaggaatcaaaacatggaattattttatttctagtgtcagaaaatattacagccaagatactgtttaagggaagcaaattacttcaccagcttccttttgagctcctcatgaggtttaattctcatgaatgggtcctagagccgacatttgacatacacatcagcagtgccctcttcggaagggaaccgcacagtcacagccatgatgttggcatgtctttatggccttcctaagtcatgtgctgtcttttgtcttccattggcagaaatacaattagaaggccttgttctcaacagaagccaaatgattgccaaatctgttcaactgatctctagagaattgaagttagctcatggccctctggctgttctctttgccactcccaggagttataggcttaaagttatccctttcttttgaaagaggatcaagtttggttcaaagaagcttttctatcatccccaggagtacaaagagagcccttccatgaccctagttgtttggctcagaccacttatagcttactgtaatttaggaagtaattgtaattcataaagccaggtagataataaacatcttggcagggttgagtttcaggcagctctgaagggaaccaacatgtgagtggaatggtattgggaacatttctagtctctgcttgcagatcttgattctaatggatgactcaaactggtttaattctgatctgaaatgtgcaggcaggcagtcattactctgtatacacatagctgaaaacatcatcacttaagcatgggttttagacattctcctggatgagttagttacccatggtagacaaatactgtaagtaaaaagagcattctcctaatttctatgttgtgtgattaacttcagatcatttatattcctggagaaatatgtagcactattttttctttaaaagatatattcttgctgaggtagaataaagaacagaaaagttgtaagaggccttagattttaggttatttaatgtcatttaattttgtattcaaccaatacttactgattgcctgttatgtcttaagcgctgccgcagaggctgcaaatgcagtagtgtcttgaacaaactagtgtaagatgaacaataagcatggcagaagcatagtagcaactaaattcatgaagtgatatcatagtgataagcactatgaagaaagcaacaggataaagagacagagtctggctctggagagggggctgctgaaatagtgtggtgatgcaggccatctgaggatagtaatgaaatttgggggatgtctatgggagtagatgctgttggatgaatctttggagtactcccaaatgattgttcattcatttacttactaaaatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaatttaggcccagggaggaaatgctttgtacaaaactcactgctggtggctgacgttggcaagactggaatacagcccttgacttctgctttatttctccttgccactgagccatacagagtctctgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcgtgggtaccaggggctttgttggaccttgattacggttaagtcaagaaaatggaccttgccaagtataactgccgcaaactagacagagaactgtatgagacttcttattggctcatagacttctctgtacacactctaaatgcatggtatgtaactactccatcacttgataggcattccaggtatgtaaactaaataagatacatggcaagaaaaattacctgctgaagacaaaacaacaaaaacaaaataatctgtatttttccaaactcaatattcaatattcaagggagtatgggtacttgtgtatatattttatacttgtctacttctctccagtaataagaatgatagaagttggctcagttgattagtcagaggctgttgaaccaagatgtagggtcgatccttctgtgtaacagtaattctctccagcgaaaagagctttataacaatatctttatatctatttacattcttaaacagtgcttctcccatttcttataatatttaattctcattgttaagagattgttaaggcagaatacttagtatcccattctatagatgagaaaattgacacccatgtagcttatggaattttgttcaaggtgctgtgaattccagctactctggaaattcactgcctcaatgaaactggtctaaatgttggttaatagcctctatttataggttgctgatagtaggaattatgaaagctggacctaaggcttcctaatgtgaggctttggataggattatctgctctgagctcttagccagaaggcccccatatttatcagtgtgcaacaatcttgttttgacagcgacaaaacccaagtagtgtcacatactcagcttaacaatttttcattggctatgtaagtaattatgttaattttatcatattcttattgttaagtgggacagaacaccagggagatgtgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcggggaatttttcaagctcaaccaaactatgtatttatgagaggctatgggaaatctgcatgctaaagattattaactgcattctgaataattgcctttatacagaataacggagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcctgtttgtgtacatttagtaaactttaaggattgtaccaaatcaaagtatcagttattatttttggtgtataaaggaatataaattacttttatgaagaattaagaaatgtatggatttggggtataataaggtttacacagaagaagagctttttcacaaaattcccaggaaagcagggggaaactcacttagaaatctagaagcccattttatattatgacattatccaattatcccagagtatcatatacacaattccttagataatccatttgttgaaaggacagatataaaatataggagaattaatggtgaagggaaaaaatagaaatacggtgcttcagtgtggtagttacattaaatgatcaaaggatgacaagttaattgaataaatgtcttagccccttgaaatttgtatagggaatttataaaactaacatttattatatagtcaggactgggttctcgctttgataatatgtgaactcatttaaacctcacaacactgcaatgtagacatttcagtctacaaaaaccaaaggccagaaaggtcaagaaaattgcctagcttttcgaacccagatcacctttttcctactgtttcactaattctcttactataatatggcagaccttctttgatgtctgagttaataaatcttcacatgacttatgttgtaaaggcaaaatctatcatttgacttgtctcggaaggaaaggaactcaattcttttctttctctctcaccatagtcttagtcttctctgatatgttcattatgcccatggcatgagggtctgacccacagtcctcagctcttaggccccttccccctgccccacatttttcaaggatcagaacacattcaaaagaagtgttttggaagacctagcatgtcacatgggttatgcattttaaagtaaaatattacctctccgggcattaaggtataaataaactaaatgttctataattgagattttcttttccgatttagtaaagctcagatcacaatcctaaccctagtgcttaagaataaaaaacagggcgtaatttactttgtgaagaatgtgatttttagctcatggcaaaattgaatagaacggcctaattgctgtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagaccagcctggccaacatggtgaaaccctgtctctgctaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatctgcgactcctataagagtattagatattaaagactcttgttatagcacaacattaattccaaagtgggttaaaataagttttttttcaagtgccaaatccaatcccaactagaatagattcttaagagtcatagaccaccaccatactgcctgctctctcaccattcataagtaattactctcttctctgcattcccatcattcattactcgtgcctcaatgatagcaatttgtcatgccctttgcctcgaatcagttgttaatagttgtgtccacctgtctcactgcattgagaacctttgagggcaaggatggcatctttatcttccatctcttcctctgtacctgccaggctgttgaacactttgttccattctttaggctttctgcaatattagagtaagtgaggaggcagctctgctctttagagaggcatataagaagtttgtttaaagagagtttataagaaaactgaggcaatagatgcaaaaagttatgctccaaaagattaacaaaaaaagttgaaattatttcactgaattttcagttctgtgtttcatagctgtcatcttcaggggtaggggggtgtgtcatgacatcaaaaaagtacagtttagagatttgatgctatctattaaattgtttcaaaacgtttcctatctatcaggaaaactttcatctgtaaaagaggaattttgattctaattgaaaaatcacagtcataggggtgggatgctgttaagcttgagattattattttcagtctgtttcaaaacacacattacatgcagatacaaatatagacttagattaagatatagacaaaggacattagaaagaccaagagaaatgttaataaaaagttcatgtctcacaggaaggcagagctgttggaaggttatctagtatagggtcattagaactaccaaggtaaaatgatatcttcacttgcaaagcaaacccaaaagtactgccatcatttgggaagcaatcttgatgaccagaatcaaggtagagaataagtttttattccataattaagttaggcaatagcagtattctgagttcagataatggcactggcatttcaagagaaattggctgagtcatagccctgctcctttactgtaccacattaccattctgttgggaacacctacacttgagctgtacttcccaacctttttcacatcccagttcatgtggaaaatgatggcattcattcagcacacggagtaagtggatgagatctctcctgtcctgttcctgaggcaaccgctcaggaactctggacacctctggtccttccgaatcctcccaaatatggtgcatccggaacccacttgaaacacactgtgtgttaacctgccagttgagaagttctagactggagaattgttttgcatggttaaatagaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatttatttgcatgtaacttgcagatagcaagcctgaatgtcttctttctatttgaaatacagtgtgtgtctaccgatatacagattccatataatgtgatgtagcagagagagtctccattggacagagaattaggagacctttattgtaactcccaatctgtcactagctgtgttctctatctataccttagtttcttgaatccagcagttggactagaatcatggttttcagatagtacaggttccatcccttcatgcccttcagccagaagtgattttgggctctttaatatgtgctttttttgataaattgtttccctgaagaaaggattatgggtgaatggccaagtaaaagaaggtgaaaattcctgggctagtgtaatctctaaagacttttcaagactgaatgtcttctaactctctctttttttctttttgttcttatctcaacaagacctaaactatctagatcatgagatgtcactccttatctttccaagagtctttcctgtttcacgatattgtttttgtacctaaaaaaggtaaagatgaatataagatcacattttaattttataaaatgaaaatgttgttaacatttccaaatggcagtaatcactttatagtcttctgaatcttcaattacttatgtaaatgaagactgtatatcttgattttaaatactcaaaattgaacacttacatatacctatgtaatatgtaaataatggtaatattcttattctttatcatctcattagtagttcacgtttatgttatctatatgcttcatttatattcatatgattcttcagctcttctgcctgtgagttacaagttatttatacaatatccaaagatagaaaaaaatactaccccattgtatctctgacttaaaaacgttgcatttgggggttttctgtacaaagttgatttgtgatttaattgttagtttcactgagtttttttgtttttagtcacaattgtattgccaacatttcagaaaaatttataagctgtgacttttagcaacagaatctgcttttttctgctactctacgtcctttcattttaaccatactttcattggagtagcctaaaacatttttttatggaaaaaagtcctcaaacagtgcctgttgcaaaatgaataaaatttggattcttcattcagctttggccaaaggccttccacagctcgttaccaattacttactgtgtgtcatgaactttgtagtccctgggcaaggatgcttactattgtggataccgtagatagagtgtacaataggaataggaagtataagaagtataaggacttcctatactttcccacaggtgttgattgcaaggacacttcttgataactaactgtgtgcaaatctgcttcagaatttgtttcctaggaaacacaacctcagactatggcttcatgggaggagagaggagtgattgcagtttagtcatagaggttgacataaaccactaaatcaagtacattgtgttcagtgtcataggggaagcataatacaatcctatgggagtggaagaagttacttacttttcttggaatacaacagaaaaagatttaggaaagatttttcagaagaggtgacatttgagtttcactttgaagaatgagtaggcattctctaagcaaagtagaatacaagatagtctgggctggtaaaagaatgttgcttattaaagatgtggcagaaagctcagtgtggcagctgggaggaggagtccatgggaccacgatggagctggatcagcagtccagtcacaaagcacgctactgatattgaaggttcataagctggaaggtgctcttttcttttaaatccccagctatcaatgctggcaaccctactagacaaaaaaataaataaataaataaataaaagaaaaaagaaaagaaagaaagaaaaagaaagagagagagagagaaagaaagaaagaaaaagaaaaaagtgatttgaataggcatatttagagacatccctctttcacttatttgcttaaagactttcttttttttcaaaaccgatttatttgtcaaccatttcatgtcatgggttcagatgaatccaatatttgtatgaagcgtgcatctttttgtctggctttaaaataatcatctataacacaaaaatatccctctatgatccttacaattttaccattagcaatttctagaattatcagtggaggtgcatagtaaaggtaatatagtccaggtttctagcaaatgaatgcccctttcaaacctctgataaggggttatccagttgtttttgtatatttctgataatgtaaacatgtatctttttctattgttgttaatactgatttatcacagattaatacaattacagagtttgaattaatcatttttcaaatgagaaaactgagatcgaaggaataaattatttacccaatgtcatacagcagattttgacaaagccagaaggataattcatattcttcacctagcaactttcctttttcatggccacataatgaattccttagctccctctctgcattattaggagtcaggtaactggggtaccagtcccacctctgcatctcatgctctccacaactcaggtccagcacatccattctcaaagtctgcctgctcacctgtggaatgagagtctggactaagggaactcccagccccctcctcctgacactgtgagtttttcctttctcgaaggctactggtaggccccactggagactgaaaggggaagattgcagtaaaaggcgcaggctgtcgaaggataacatgtccttctacatcattcactagcctaggatgccagtcaacttcattcttggaacctttattttccaatttgcgggcattttgcaataggctgattttaatcacattttatactttttttcctttgttgcagaaatgtttgtattacctgttctttgaatgcagcatctgtagaccacaaggtctttccataggaactaagcctgttatattgctgctagttttgagtaaatgagctgaatcttgcagccaagcctcagtgcaaacaaaaacattttctggccaaacattttctggttattcaactccattacagggctgactaaaaaaaaaaaaaaaaaagtaaaaacccacagaggagcaaaacacaagtcctgggaagacaatttccagccacattagctcacattgtcagggtagaaaagaaacaggccctcattcttcaaaccatcatcatctccaaactcttaccctgtgctcttctgctattttaatttcaccacttcaaaatgggaaaaacaaataggttaatagtttccatgcgtttagactgtgaccagaggcatacgaagcaatttcagaacctcaggcaaccacagctttgagggaaggatgatgatggatttaccaattcatcttgggatggattccagagttaagggagtcaggccagcactgtgctgccagagtgggatataaacaatattcattcgttcattctttttgtacacattcatctcaggcttatttctatttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtcaaaatggcaaattgcgatacatctaggcattagccaaggcacagaagtatgggagtttcacataggtttgaacaagagtgagtggtctgagatgttatgagaaccataaaggggggttggataccatgtaaagaataagctctttttacattgtgaagccattaagattttattatccagaaaggtacttgtatttgatcacatctgtgtttggaaagaaaactggaagtcattggagacaggggcaaggggagtattataagaagagagatacaaagaagccaaatcataggtcattgctataggttagacataaggacactagttacctacgtacagacacttcttgcttcatagccatttatatatcctcatggtaaaagagcagctacccctgaatttccacatcccattcagttctgcatctttctaataagatccacatcccgggtttattcctgattgtaaactcaatgagttaatccagatacctcagttgtaatatagcattttacatgtgaaacgtggttgtttgctaagagcatggaattaaagggcaggatggaaagttaacagccgatctttctgagacctgactcactaactggtgtctcttttaaggggtgctatatatttttaaagcttagaatatttttaaggccagataaatgtgtttcttaattcactttttcaaaccagctcccttctacattcaacatttctgtcaagagtttgcaaactctaaacttggagatggtgtgtaaatcaaagctttaaatgatcagaagcctaattgattatgctgagttctgatttgggttctgcatttagcatgctctgtctcagtcatctgacaggctattctgtaaaaagtaggggtcttagtgatcgcactatggtctaagtggtcacactatgtctttgataatgaatcaagttttagaagtaatagtgaagcattcctcaatcggtgaaccagagtggtatagttcaagggtcaacaaactatgcccatgggtcaaatccagcccattgtctgttttttttttgtaaataaagtattactggaacacaagcatgcccatatgcttgcatgctatgactgctttccagctataatagcaaagttgacttgttacaacaaagccagaaatatttactatatgggactttagagaaaagtttgccatcacccatgctgtaggaaacaagggaaggaacaaggatagcagtcagaaaacacatgtcctcagttctggacttgccacctactacctgagtaatactagaaaagccacttgacccatctaattgtgtttccttctctctataacacacttctttggccagtttgttagttaattggccgataacacttgttttctatttgtaaggactgtattaaagctgtagatgtggtttgtaaatggtgataaatgccttccttagagtggtgtgataaggacctgagacaatctgttttgtaaagatgcctgtcatgcagtatggacccccttctgtcccagtctgacgtggtttctgtttccttccccagaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagtaggcaacctactctctcgtcaccaccctgccagtccttttggagtctgttcttactgcttggcatctgggcatacattcttctctctcagaactacagaatttcaggatttagtgaggcttttaaaagagcttattgatcccctcctccaatgcaagaattaatatcagacaatccatgcagtcatccagcctggtctctgtgtcaaggcttccccagagcttgtccattgcatctctgggtaattctaatgacgaaaaagctggctcagctatagtgtgtatgtgttagaaagaaacaggatcctggcctaaatatgaacaaaatttgtgacatttggcattgttcaacttatttgagctcttcagtttggtctttagatcaaaccctctctaaagctctctcagctgtgatgacccagagttttctcaagagctaatctgtgcatccctgccactctactgatagggagttatggtggacagacacagagaaccattcagtttcttttactaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcatttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggctggagtgcagtagtgcaatctcagctcactgcaacctctgcctcctgactcaagcaattctcctacttcagcctcccaaggagctgagactacaggcatgcaccaccatgcccagctaatgtttgtatttttagtagagatggggtttcgccatgttggccaggctggtctcaaactcctgtcctcaagtgacccacctgcctcagcctcccaaagagctggtattacaggcatgaaccactgtgcccagccaacgtttggtttatatttttaagaactgtactaaacctatagatatgatctgtaaatggtggactcaggtttctgtatgtgtttgctgggcagtggctttgaagacagcctttgaggctatcaaagagatgaagcttgtattgctcaccaggttgggtatccattctatggcttccaagtgtgaagtcttctgggttaattctcaccactgtgttgattgtcaacagccaggaagcacttaccccaaggagtttggagatctgagactcatattttaagaatgaatgtcctaaccactttccaagtagcaaagaaagtgaaaacctcaccaaaagacgtgaggttgaatgaattaaaaaatcccagaggcggaaatttgcaacctgaattagacaaggaaggactcacttttaaagggcagtcacagcataaattgtgcttcacattattgatatttttagcttgtaattacacattgaaaaatccctgcgtcttaagggaagtgaaaagatctcaatggggagtatgttctgttactgtttctctcctttcttagacttatcctaatccaagaaagactgatacttataatcggagcacacatgtttctgtggctagaaaagactgatacattacacccctcaattaaaacaggaaatcaattttgacaaatgccaatttatatctatgccatttatctttcatgtctaggggtagggagcataattagagactggtgactgatgacatcagtttgtgggtctgaaagctcccaaaaagcagacttgagcaactaaaagggggaaaaaaattaaaacccccagataaccttccccactcgttcaatgcatgttaaaacataaattaaaaatgataataatgttgtcttcatgattggcaggtatgtagggagagaagttttttgatcctttctccatttcctaaaggaaaataagaaactgttttatggaactcttatttataagccttaaaattactagaatacaaagcagctaaaagtccagcataggctaatcactgaaagaccaaagagagggcagacaaagggatattcctcctccagacagtttttggggccttgtttgtggtccttttgaatgggtctccttttgtggacctttagaaaatgcatgttaattcagttcaactcacatttataaagaaccctctgtgtgccaattgttgcattaaatgctgaaggagagagatacaaggagagaaattgtgcagatatatatagagaagtcactgtcagcaaggagcttgccaggaggagggcagagaaagtgtgcagacagggagaaagggctgaactccatgagacaggcacaggtaagggcttgcactgtcaaagtcagatcacctggctctgtggtcagaataggctttgtggacggagaatgtcaagagtgttttaagtgggaaacaaggagattcctggcagagggaacaactcaggcaaaaagcagaggcacagagttagtaaagggttctctgtgttcagggagatttgctttgctgtaactagagcagcctgggagtagagattaccttgagatacaggagacccataagaagggatttacctcacctgcttagcctgccttttatttatttatttgtttattttatttatttattttgagatggagtctcactcttgtcacccaggctggaatgcagtggcacaatctcagctcactgcaacctctgcctcccatgttcaagcaattctcctgcctcagcctcccaagtagcttggattacgggcacccaccaccatgcctggctaatttttatatttttagtacagacaaggtttcaccatgttggccaggctggtcttgaactcttgacctcaggtgatccacccgcctaggcctcccaaagtgctgggattacaggcgtgagccactgcacccagccttagtctgcgttttaaaccagtgcttcccaaactttaatgtgcctgtaatccacagagggatcttgttaaactttggattttaattcaggtctggagtggggcctaagattctggatttctgtcaagctcccaggtgcccatggcctgcactttgtgtaacaaggttctggaatactgtttttgagaacttgttaatggaccatcctctacataaacacctttggtcaatgttgactcatatcctccagcctactggacatgcaatctttcacatatgtcatttcagatgaccgctgcaaccactgcagtcttctggaagactatctcccctaccctaacacacacgtacacattttctcatttcacctaaatggttatctttaaaggcccaactcaattaccgtttcctggaagaaaacttctctgatctccacccctcccttttctcaagtttagatttacatcttaatctctgtgttttatagagttttataagtctgctgtagatagcacttaccacagtctgactggtatagaaatatacatatgtgtgtgtgtgtatatacatatgtgtgtttgtgtatatatatatataactttacaataatcatcttgtatcatttttgcaataaggatttgtatatataaattaatagaaatactgcagaaatatatagaactccttctcaggtctgtactggaagtcgttgcttattcttgtattcccagtgagaaaacccagaaaagcagatttctttaactgactctttgcatgtatggaggctttattcccctatctgtgctttcttatcaggaatattaccctcattcatttatgtatttaatcagcatccattagttgattgccagaaatgtgccggaatacaagatgaccaagatcatccctctctgagccttcgctctgttggctgtaaagtagaaatgataaaaatacttcctcataatgttgctgtcagtagaaaattacgtcaagtgtgtacagcacttaacagggcttggcacataataagcactcaataaatggtagctttaatcatcgaaagttgttttcatcaaatttacttttacgattattgtccactcagtgagctaagccttgaaatagaccacctgggattgtgagccctcctcgaattgctatcggaggaacactgtggggactatgagaaccacctcctgcctcttcgctttggtttttctcattatggaaatgaggccaattggtaggaaagaatcattactcagcaagaatacagtttatgtcttcccaaagaggaagaaccttgagattgaacataaagcccaactaatatctttttttatacagaaatatggcagattcatttcattagatacagcccaactttttttttctgcaccagtcacagtggttgttcctggagactcagagatggagcaaagtcctatcttgtggaaacttagagtttagtgccccataaatatatccaaataattactaccaaaatggataaattcaatgacagaattcttatcttagaggagtaaataattctatttggggaaattggagaaggcttatggatacactgaaaaggaaaacatacttctgctcccacagagtttggggaaaggaaattttgcagttgatcccagaagcctacttatttcaccactgatgacccagatttaaaaataatctggtagtccaaagcaattttttgccactgaatataaacttcttgcataaaataccaattataacaactctgattactgctgcagtggtaccatgatccttctaacttttctttcacagcaatcaattgatctgctgcttaattcatatttatttagattgcagccatacagatgctttttgggtgctgccaggaaaattaattacctacatatagaatataatgtatgtagaaatgctttgacaaccgtaacgtgctctgcaaagagttagattattatcattatttctttttaagtctcactacaaatagataaatttttaacatcgtttatcttaaaaccagtaccatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagtattaaaagtatttaccagcagcctcaaaaacatatgcatatgcatatttatatgtatatgtatgtgtatgtgtgttagtatacactcaccctttaacagtgctaaaatcctttaaagaataaagaatttgatagctctttaacttttaatttttaagcaaaagtttaacacaataaaaaatgtaggaaatgcagacttggccacttttaagttttgtgtaatgtatatttaaacgcactaacctctgcccttttgaaaagctatgtatttgagtcttcttatgtcagttcctagaagtcaaggcaaatttccaagaaagaagctctaaaaggtgggaacaaggcaaagataccaacctcagactatttttctaggacctaaggagtgcatacaaaagtctagaaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccacctcttccttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagtgcctgtactcataggacttgggttttagatttgacactagtattccgagcacatgctgttgaataagtcactgtacctctctcagtctgcttgctcaccggaagaaaggactcaagtccttaactcctccaaatatggctgtgagagtgaaatacaaaattgtatattaaaggacattgtaaattgtgaaatactaaattagtgagaaatggtgttattgaacatttaactttggctctgaggctttggttagaacttcttgttcagagtcatggagatttatttatttgttagcatgcactactaattgctcagtttcctgaacgcctctagagctgcagtatatctgcatgttcttttcagtaaagccaaacttcccgcagagtataaccattgctgctattgtgttctggataccccgttaacttaaatttcattctatgtcaaatgaagacatgaactccattgacctccttgccaccatggtagatagcagaggcgaggttcatagctgttgtggcctttgagagtttatactaaagttagcaaacacacacctcttgatgaagtactatgtatttattttccaaagaaacttctattttctccaaagacaaaggccagcatttaactgttatataacacttttcaaaatggaccctaagaggagctgtcagcggtagtatattcctttacagttatgcagttctttgcatttttttttttgatccattatcttctttgatcctcttaacagcttggtaaggtagaaaaggcagaagttattttcagagtggcagtcggcctgtgtgcattgaggcagactgtagcaaaactgtgggtggtgctcaggaggcctgtcccctggactagcaatctttgctctccacaatgctgtctcctttagaaagtacagcaaaccactactccccacaaactttaggattttattttcttactgcagttgaagtaaatacaccgaacccactggtggcccttctgcttggcagacatcagtctacctttgctctaggccagaaatggccaaaacattccattcctgtacctgtgcatgcattttgagagatccttaaactaatggtaaagggtaaaaaatgcatcggtggttagggacattcttattttctcttgttgagtgggggcagcaaacttctacatgggagccaagatgggtggcctcttctcttcttatacctgtatttcatatcaagtgagcttaggaggattatatttatgtccatttatatttatgtccccaatctctaattcaattacattcaagatatactatgttatatattgggagaaaggatacaggggattagcagaatgtaaagcaggaaggatagtaagtggccacattatggaggccttgaatagaaagctcaatcatgatgttctccacatgtgtacttaacgtttttacttatgtcgtttccatctgtctttactgttctaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 2488 - DNA, 677741 bp, Homo sapiens
ggtcacttttatttgggggtgtggacagctgctttcccaggggagtacttcttacagtgggatttcaagacaagatcggcctgaagaaaaattatatttgtatattttttaaaaagtaggtatttcctctcatctgaggcctaacttgagttgggtagaaagacaatttgggagtgctgttgtctgatgattaaggctaaagcaacaagctggaagggatgtcgggatgtctgtggacatgtagggaggggtagttttagcttgaaaacagttatggtgggatttaagagtatgcaaaatgttgatgtgtagcatttgcacagcatccacggtctggaataccttgtgtgcaggtcactgtgtagatttgatgagttgtcagagttggaagagtcctgcagagttttcagcacatctgtctaatttcacagtgtgagataatgggcagcagagacccaggccctgaagacagatggctcattatgtgggattagaacccagatcttctctctcagttcgttctccttcccctagacttaagctgccccctctattgcgagatgaggaaattgggagatgttagaactgtccacacttactaatctagttggtgggaaattgaggactagaacctacttctagttcagacctcttcccgttaggatatatgggctcagatgcctagatttgttgtttttgtatgaggctcttttcttttctttttgttctttgatttttacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaactgggattacaggcatgcaccactaggcctggctaatttttgtatttttagtagagacagggtttcaccacgttggccaggctggtctcaaactcctgacctcaggtgatctgcctgccttggcctcccaaagtgctgggattacaggcatgagctgctgcacctggcctcggatcaacttgagggccttattttccagtgcagggaagatggtagaaatatgttttggggaagcattttattaccagtggcattaggtggcagatgtaatagagcagaggaagtgctctgagacctatgtttgttctggccagttttaaagagaggggaagcgactctctaatctgctttgaagcaagtgggaggagggaagttgcacaggactcccaggaacctgtacacaatctgtctccttctgtgaccagctgaggctgggtggtgactgtaagccctgttcatgagacaggaggagagagccttgaagaaggaaagcctggggtgtttttctgtggtgctgagggacagggacagtaagaggttggagtaaataataccagtatgaatactaatactctgaataaggacagctgacaagcattggttgcttaatgggtgccaagcacagggctaaacactttacctaaattattgtggcactatagctgcctttgagtaggaactattttttaaaatattatttttaattttggtgtaatacatataaaatttgccatcttgatggtttttaagagtacagttcaagcctgggcatggtggctcacgcctgtaatcccagcactttgagaggccgaggtgggcagatcacttgagcccaggaattcaagtccagcttggccaacgtgatgaatccccacctctactaaaaatacaaacattagctgggcctggttgcatgcacctgtggtcccagctactcagaaggtggggatgggaggattgcttgaatccagggagtggaggttgcagtgagccaagattgccccactgcactttaacctggatgacagatcgagaccctgtctcagaaaaagaaaaaaaaaaaagagtacagttcagcagtgttaaatacattcatattgctgtgtaatcagtctccaggcctctttcatcttgcaatctgaaactttgtacctataagcaacagctacccattttcctctcctccagcccctggcatcctccattctactttctttctctatgaatgtgactactctaggttctgtatctaagtggaatcataccgtatttgtctttttgtgactggcttatttcactaagcgtagtgtccttaaggttcatccatgttgtagcatgggtcagaatttctcctttttaagggtgaattatattctgtggtaatgaatataccacattttgtctatccatttaggtactattttttaacctccatgttatagaagaacagcaaccagagacttcaaagggttaattaagtaagtggcccaaagtcacatagtcagtagtggagactaattttacctaagaatggcatgtgatcaggagtaagcagatattggattctaattggcaagagtgtgacaaatcagggtgcttctcaactggatggtgacacctccttacaccttgctatggcatttcaataaagcaagtgttccaaagggctgtacgcagctatgcttcctttcttttgtattgggctctaggaagcccatagctaaatttaaagctcacctctagcaaatggtatgagacatccagctcttattttttgtatccctttctcctttctttgctttattttctcctctccttacccactttctcacttaaatcatgaactattagcatcttttgtcaggtacctcagatcatttctggaacaaggcagaatatatagatatgtggcatgatatctaatattttagtaattattaagtctgtggaatagtaggccaaaactggccatgatttttctgacttgactctgctcgtcttcttcttcttccttttttttttttttttttgatggagtctcactctcttgcctagactggagtgcagggcgtgatcttggctcactgcaacctctgcttcatgggttcaagccattctcctgcctcagcctcccgagtagctaggactacaggcacttgccactacaccccactaatttttgtatttttagtagagacggggtttcaccatgttgaccaggctggttttcaactcctgacctcaggtgatctgcctgcttcagcctcccaaagtgatgggattacaggcatgagccaccacaccccacctaactctgctcataatgcaatgtttcatctgggcaatgccctgcccctttctgagtctcacttttctcacctgaaagaggaggttactgttgatgacagtgaacatttaggctgtgctgagttttacactaagcatcctgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcaggcttcttccatccgtggcatgtattcatctaattttattaaatctttattgagtttccacttaggtgccttgcactgttctgggcattatcccagtactcgatttagagcaaagagtaagacacacacaacaacgatctcttggtgcttacacgctgctgcaggtgtgtgaaggaggcagataaaggaacacttaaacaagagggactgataagtaacccaagggaggagtcacaaagggcattctgactgtgagtgagtggggaaggactctgggaggttatgtttaagctgagatctgagtgacaaggaggccaccttgtagaagttgggggaagagcactgcaggcagtggagacggtcaatgcaaaggtcaaggctgtgaagtgggaaggagtttgtgtttgaggaacagaaggagactgatgtgctggcaggatgtgggctgcaggggaagaagcaggagaaaagaatagggtctagcaggtggtggtaagtgagagacctgagcttcttagacctgagtccagatgtgatgggttatgtgttacaggcatctttccagctgctgtggagggaacctgatagtaaaagggagtcaagggtagaagcaagaaggttaggctagacttttaccgtaattcaggtgtgatgtggtggtaactttgactagggcatagaagttgggcaggagaggtaagtttggggcatgtttgggagtgatcgtctataggatctcaagtgtgatttccttcagagaaatgctgagctaaatgggcaggaatctgggatactcagagggaaatgaaaataggtgccctagggggttgcccagataagcagctggcgttccaagaccaaagagtatctgtttctcacccctctcccatttagtttctaaccttgagctttgggccagtgcacagaggatggtggcttcctgcctttggcttcccagctgagagctgttggaacgccccaaaataagccctgcagaacgtgcagcttcctttgctctccctgggtatttttgtaaaacattctttcccaccaagaatgaggaacgttcagagtgatgctgactttatgggctgtatttaacatgttgttttttcatggtgttgtctgttcatgcagagatttctgtctcctgtaaactccctggtaaggaatcttcaatctccatgtgagatgggtctggaaggctcagtgggagcccagaagagctggggtttgaaagcctctccttgtcttgaggactggactgcggtccaagggcacctaccagccctcttttttcatttacatttgaattcacagttgctgccctttggcagttccctgtaattccttttaacaggctgggctttcctgcagatacttcatttttcaggtcttggagaagttaggtagtggctgaatcaggtagagaatccaaaattctgaccaagccccatcctctagccaccaggccaaagcaacttagcttgtgacctcatcctcctgtgtatcccctggcaatcttatactataatcagcctaagcccagagatgctcagaaatcatacactaagtcatctaaaactcatttctgaggctttctcatgcgcccctcttgcagtctgtagttaccaggttttcaaataattagcataatctcttaaaaacagtgttttgttattgctcattcaagtttcttctaaaatttcttttatattacctattcattgagttgacaaacatttattgagttcttactgtatgccaggcattgtgctaggtgctggggattgattcaaagataatttggaggcgtatggaaggggagtggataattacagcacagtgagataagtgctataatagggggatatataaagagccagaaatagcactatgaataacatctttgaacaaattgccttcttttttccttttggattattcccttatgtatattgcccaaagtgggattactgggtcatttaaaagatgaaaacaatttggcacaaaaagatgtaatgacttgcctggggaatacagctcaattttcaacagagaaagaaaaaattgttgacaaatccagatttagatcactttaccaggaagatggggcagtttttatactaccctttcaacatggtggcttttaggggcggggtgggggggatttattctaaacatgttagcctgcgtgtaggaatcacacgtcctcatatttaatctcacaacttgattgttctcacaagaacctagctgtatacatattatcgtttccattttacaaatgaagaaactgcacccttgataaaaggaagtaagttgctcaaaattccatagttaataagtgtagaatccaagggtcaagcacagttccttttattctttgactctatcctgttccccatgctgtgtttaccaattgagggtacctgtgctctagccggggcccggaatttaatatttaatgagtcacggaggctcttaagatgatggtcaggctctatgaaataggtgtagattttcttacctctgaagtcatagccagggaacaatgtctttctgtatattgacctgaaaggacccaagggcgcattattcctgaccctggctcaggtgctgaaaggctatttgcatagccctactgttagagcacagaatcccaagtaaagctgaaaccatgccacagttttgctgtgaaacatttattacttttctagtacttaacagtattaagtaaaaactcctgcccctggtatccaggacctgtcataaatggacaccaacatcggtccactgtgggtccatgtgggtccttgatgctcctgcttacatatctttaaatcaaacacatttcctaccaacccccagatatatcttgcactttctcaccttcatgccttagcacatgcctttcctttagcctgagataacctctccaatcttcattcatagaactcccaatcctcctgtaaacttctgcacagacgccatcttgggaagggaataatccttgatcaccacctgctctcccatccattagaagtgatctctgtgttctctgttctgctaactcaaccacagttagctgtgaggcaatagagtacaaatgtatgctgcatatgagcatgggatatggatttgaatcccggctgtgatacttcctcactgtcagttaacttgcttgagcctgagttttcccatctgccagatgggtgtgatacaataggtgctccccctgaaacccaccatgttgacaggagtagtataaaaatggtctgattctcccggtgaggtcacgtaaatctggaatcgtcaacaattttcctttcctttgttgtcatgacttttttttatgacatcacctcatgtcatgtcaccgtgtggtatgaaaatttgcattgttacctgtgcttcttctgtggcacttgtcctcccttacttgatgtcttatctctccttctagactgggagctcttcaagggcagggagggcattgcatctttgaaggccttgacatatggatactgctacaaagtttcctttaagggaaaggaggattccatacaacctaagtggtgacatcagcacaggctcattactaatctcatgtcacgaggtttcaggcctggctgagaactctgtgagctctgtgatgttgagcttcaggcacatagagtacaagctgggtaggcctctggctcctgcttaagagacagcagaaaggctggatggagcctgtctccagaccagcttcttctgattcaaggagttgggtgggactggcagttcactgaaggcagagtggtagtcctgcttggaacgtgaaactttgtttctttcctgggccttccagtgggtctgttatgttggtgagagtttcagacctagaggaaagggtcactgaaggtatgggttaagagcaactctgaaagccacctgccccccgacttctctgtgagtggggccacagggagaagatcccttcataggtagctcccctacccttgctatgcttggaaactgaccatggaaagggattcatttcttaaagggatagggctaccatttaactttctattgtgtcacttcccgaaacgcaacacctatggcttaagatccaagtgctttagaacatgagatacaaggtcttccaggctctggctgccacatccctttccaggcgtgtgtcccaccacattcctctgcatcctctgtcactggcctcaccagattagtcactttctctgagaacaccctgaactcatccttctcaaggcctttgcacattgtgttccctgagcctatttttctcctcctcatccgtggaaatcctcttgggtgttcaggcatcgtttagaagtcacatcatctgcagagaacttttagaccctcaaaaggacgttgcatgtactcgtgcttttctacacttttcattctgtcttttgtgttccagtgtgtcccccattgaggctcttcgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttgtttttatcccaaagctccatgaaatatgaaaatagcaggagttttaaaggtatatttccacctctagaggaagaactgtccatattatagttgtaattataaattaataaagcctgtgtcatgaaacttgattttgaacgcctgtgttcaaatcctggctttaccacttactagcctagagatattggatgagtgtctaacttctccgttcctcagtttcttcagtgttcaattgggaaatttttcttatggttgatggaaagtttaaataaggtcttggatatgaaactgggattttattagtgtgtgtgtttcaaaatgtggatttggaggccatttaaaaatagcatttccaaaaagtttgcttttaaagcaaagtacttagatatataaatttttatgaattttttttcaaatgataaaataaatgagtttacagtcaggagacatacagtatctaacaaacttagggaatatgcttggcttacaagacgtggttttagtccacataaattagaatcacagaactataggctttgagaaattataaaagccttggaaggggtgaacgtgaattagtgcatattgtgtgcaggctttgtgccatacgtgctagatatgggatcccaggaaatggttgcatacaccttgttgggtagatgatattaaccctgttttgcagacagagaaacctgagctttgagaaaatcctttacacaagtccaatatcaaagtctggaacttcaaactgcactcctgatggcttctagaaatcctttccatttacagatatgacaagacttgctttcacattgttgattttttttttatcctctctttctctgtctctgggggcagcactaattcagggccagatagaactgtgaaaatctgcagtgttgatgtcacataacttgtttaatgaatctagattagtgtcttgacttttcctgccaagaatctgctcataaagtgtcttgttttgagctcctttaactgtactcattcatcagcctttacttattttcttctcttttggagagatacttgccattgcccataatgtttgaggtcaggagtatatttgaagagggctttatattttcttaaaaaaaatacaggtggaaaatcaagtttatcagctatttcataccatcttcttctgccatttatgggcaacatgtggaagaggtggcagggagctgggagtttggaataatgtgtctcatcttgaatttgtcgctgaccagggaaaatactcaaggccaactccatcattcccttttgggaattcggtgcttcagctgtaaagagtgagggcactactaggtgattcctaagatttaaaattctgcatgttttgtggtgtcaaaaccatcaatttctggtgagctgcgtgatcctgcagctgtttctctgatacttttcaatctttagatttaatctattcaacaatgtataattttttaaagggaagcttttatagatacttctgaactataaccgggtgggggggataaatggatgttaaaaaatagaaaacaaccaattaaatagtatatagcatgtaattctccttggaaacttaccacgaaattgagaagcactttaacaactggtaatttaaattgcgtttgaactctgctaatggtttgtttgcatgggaacttcaatcatttcacagtggttctttagcaaagctgcttgttctctttatggaaaataagaaaaaattattaaaagagaagttggctatggaaaatggagaccactttcatttgtgcctggagggaagctggagagtgtgagtgagactccctcagggccaagggtggagagctcttcctttcagtgaagtttaaaaatctgggaagtcagatgccctttgctgctgttgtagaaactgttgtgatttgtatctctctctgcaaggagaagctttggttttatgcagcttgcgggtgagggtagggacaacctttttcgtttgttttatgaaattgcattgttcacaggtctaatgttggcttcctaacaacccatttctcagtaagtttgaaattatgcctctctctcctttcagtggaaatggctttcagaattccaatgtccttgaagaccactaggtctcaggaaactccttgcttttctgggctgatagtgattatactccattttgcctacttaatttctgtctgctgttgaggttactgggagagcgttgaaataggtgttcgaggcctggatttgtaagtcctggtttggctctaggtgtgactcatgtgaccaagcacaagtccctctgcccagtgtgttttgttgtcctttgtcaaagcaagcagtcacttgatccagtggatcaagtggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctcgtatgtggatttctcctgcatacatgaaagacaagttttataacagcccttgccttgggatacttgtctgttggcatacatactgtgtaatcattagcaaaacaataatagttgctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatggctgaaggcaaaggaggagcaggtgtctcagatggcaaaagcaggagcaagagagggagtaggcagaggagttgccacacacttttaaatgaccagatatcatgagaacacactcgtgatcgtgaggacagcaccaagaggatggtgctaaaccattcatgagaaatccgcccccatcatccaatcacctctgcaggccccacctccaacagcaggtattacaactcaacatgaaattcagaggggacacatatccaaatgatatcaaggacggcttactgggaaatgtcaagattgtttatccctctgctgctcactgattctcacttttcaggcaaggaaactaaagttcaaagaacattaggtcctatagttagaaatttgtctccaaactcatattccttttctttttttatttggtatagtttaggtttatctgttaatttttttcttccctacaatttgagtatctaactgacttgcctctttcacctccattattaagatgaagctgttttcccaggagaactaggagagctgagatatgaacactgaggcatcagcattctctttccccatcattctgagtcaaattagtgaaataagagtgccaggatctgactaggagtttaggaggtatagaagtaaaccacggcccagtcagagactttataagcctgggaatttctgaagctggttaagaccctagagatacataagcaacacccttctgtttttcataggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtactcacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatgcctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcttggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatatgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgaggttgagtgaggtcacttttcacctctttgtcttctttgcttcctaggagttatgatgtccccactattcaaatttatgtcaaagatggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattattggttcccagtgcatatgaaatttatgtttacactatactgtagtctcttaagtgtgaaatagcattatgtctaaaaatacagtatacataccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtactggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtgacacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgctttttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggtaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatacttgtgtatgcaaagactttaacatttattaataattttttctatagattggtgaaattggtttgtaatttttgtcatttcacttttgtggaaattgagcaaaagtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctttctctttctttctttctctttctttctttctttttctttctttcttttctttttctctttctctctttcttttctttttctttcactctctctctctttctttcttctgtttcccctcccttccttcctcccttcccttcccttcccttcccttcccttcccttcccttcccttcccttcccttccctcccctcccctgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctttctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacatgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttatagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctgctgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgaagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttcgctcagactcaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctgtctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggatttttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgtcctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaagaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtagatgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatctttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaactttttttttctttgaaacggagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcaccccccaccctccaactctgtctctctctctctctctctctctctttctctctctctctctctctctctctctctgtctgtcctcctctcctgctgttgccatgtgaagtgcctgctcccttttgacttctgccacgttgggaagcttcctgagcctccacagaaggagatgctgctatgtttcctctatagcctgtagaactgtgagccaataattcaacaactcaaccacttcttttcttttctttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacccatttcttaatctctctaagagacatggactgtgttaaagtgtgtttatgaactggtggtcgagggtgcatttccctcctaagaaaactcattccttgttatgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttattctccattcccatgatttagccctctaacttcatgcatttctttttgccctttttcttgtgctggattttagcccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacacgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacccgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaatttgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagtgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaatttttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacagaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttatatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcggatcctctatttcctaattcatggcaacttctggagaacagtattttctctgttactgctttatggggtttagtgtggaaattaaagaagagaacttcttattttttgtaaataataatacaatattcagatactgttagtttctgaaatttaaaatgggcatctcacttctgtgttccctccccaaataaatgtattgatactaaaaaggaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttatttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagtggaggtgtaaaaactagtcttccagcctccagtcctgtctcagcattgctccccttcacgtcgttgtccagagctcctggtggagccttggccttttccatatgtacacgtgcacacacacacacatacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctctctctccaccccccaccccccacccccacccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggaggttattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttctctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagcgtcctgaccatctgtttctttctaccccaggcccattcccatcatgagtatttattctgcccagtgtgggatgggttctgttctagaagtttgcatgagcagagggaagcttagccccatgaggccagtcatgaggctccatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccgttaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccatttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagactttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcaacctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattctcagggagtttagagacaacataatgaaggtattttcaaggtttggggagctgcttggaacttgattttggacaaaatggaaggaaaacaaccatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttgtggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcacagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggtgtgcaccaccatgtccagctaatttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacccatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttctctcctcctcctcctccttctcccttctcccttctcctttctccttctcctcctccctcctctccttctccttcttctttttcttcttcttctttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccggagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacagaaagataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaattttttttttttagttattcttattttctaattattttatatgctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttcttttttttttctgttttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtcctttgtagggacatggatgaacctggaaaccatcattctcagcaaactatcgcaaggacagaaaaccaaagaccgcatgttcttactcacaggtgggaattgaacaatgagaatgcttggacacaggaaagggaacatcacacactggggcctgtcatggggttgggggacgggggagggatagcattaggagatatacctaatgtaaatgacgagttaatgggtgcagcaaaccaacatggcacatgtatacatatgtaacaaatctgcacgttgtgcacatgtaccccagaacttaaaatattaaaaaaaagaaaaaaaaaagaatttgcatctatttttagactttctgttctattcatctgtcacttcatgtgtcattattatgctttcaattattgtagctttataatatgttttattatctgacaaagattccccattcctattagtttctctttttcagaaaatttctggcttttaatgcctgtttatttttcattgacctttataatgaacctatctagttctggctgggcgtggtggctcacgcctgtaatcccagcacttcgggtggctgaggtgggcagatcacttgaggtcagaagttcaagaccagcctggccaacatggtgaaaccctatctactaagaatacaaaaattagccaagtgtggtggcgggcacctgtagtcccagctactcgggaggctgaggcaggagaatcgcttgaactgggaggtggaggttgcagtgagccaagatcccgccactgcactccagcctgggtgacagagtgagactccgtctcaaaaaaaaaaaaaaataaaataaaataatgtaaaaaagttctgttgatatacttatgaggtttgctgggtttatttgttagcattacatgctatacattgtaaaaatgttgattctttttcttggaatactaatgcctttccatttgttgaaaccttctttgatgttcccaggagcactgagatttttcttcatgtagaccgtgcctgtttctaataagttaattttgtagatattttctacttgctctagttaatgtaattattttctatttcatttaattatatgtgtgtgtgcctctgtgtttggggtctggatttcagtacattgattttctgctcagccactttactgaattgtctcattatttgaataattttagataaattttttttgagtttctagttaagtaagtatattatctgccaataatttatcctttctttccaatttttacaacacttatagctttcttctaactgtactaatacctctagaatagtaaatattaaataactgtggttgagtaaatgtccttcttttgtgtctgagtttaatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaacatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcttttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaaccatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggaggttgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctggggggaagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgtcaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaaaaaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagtgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttaggcatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgtttgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatagtcatcttccatcttcactttagaggtgggggaaaagggcattagagtgattgtgtggtaaaatccactctaattctagctgtgagaaaaagagcggtgaaaatgtggtaagcaattgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccattcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcatcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaaggccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttaaagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctaactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagtctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcgcaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgttttcccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgttttttttttttcctttggatatatgaccagcagtgggattgctggatcttacgatatttctttcttttttttttttttttttttgagacggagttttgctgtgtcaccaggctggagtgcagtggtgctatctggctcactgcaagctccgcctcctggcctcctgggttcaagcgtttctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtggttttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcctctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccattctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaagggaatggtttgagacataatggtcattgtgatttttcaagctataaaataaagcatgatgttaaaagatgattaatgttttcatttggtggtagatgacaagtttcttgcagggcatctgatcaatcatgctcttttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgcgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatatatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtaaacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacccacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctagtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccacgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttctcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcacgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgacaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacaatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcatgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcgaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgccttactctcactgccatactcctttggacatcctccttctcttgtttcctgatacttttacatccccttccatcctttactccttagcttttgtttttatttgcagtgttaaagatagcctctttttatttccctgtagtgattagatcgacgtgtttacaatatgaacacacacgttttctcttcttcaggctctgagtcatcgagttcacaatgccatgtctagtcagtacttctatgtgtgtatagtgcccattgtggccgagtagagataaggtcactgcggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttattttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctaggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttctattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaagaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgcttttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttctttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggctttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactctcacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcaatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagaggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttttttttttttttttttgagatggagacttgctcttgtcgcccaggctggagtgcagtggcgcgatctcaactcaccacaacctctgcttcctgggttcaaacgattctcctgcctcagcctcccaagcagctgggattgcaggtgtgcaccacgacacctggctaattatttttgtatatttagtagagacggggtttcgccatgttggccaggctggtcttgaactcctgacctcaagtgatccgcccgtcttggcttcccaaactgctgggattacagacgtgagccactatgccaggccagttgtgggaattttataagggctttttcttttctttttttttttctccctctggcctagtttgtggggagaggtatgtttccccaaagatgtggagttagcctgttgatgtaggcatgggagagtgagcttagacagagatgcctctcatataaggtagaaagccttccatgcccaacccaagtgttgtagaagttgaaaggggaaaaaactttttcaaaattggcttgacagcaaaactcctctcagtgtcttcttttttgtccccctctataaatggtaggttttcgtagtatcatgaccctttttagtaattataaattaatataagataaatttatggtattccttactatatagatttgttaaaataattcacgatatttcatatgtacacacaagctccttcaatccaattagtaagaaaaacacttcatgtcactgttaaataacatgaaaataaacaactggttaaaaaacaaaacccaaatacaaagcgttgagcttcctactggaatctgaatctgggagtgtcttgttgtaagaaatgttttcagacctatcattttcttttgtttctttttctttttttctaaacagactcttgtcagttctcttctgattagtgttcccctgggcttttcttcccaaaataaagttaagtgcattcaagtttctgggatcttctttacatccttttgaaaatgcagagtaaatattatgttggcttctttttgttttttttttttaaattttattattattatactttaagttttagggtacatgtgtacaacgtgcaggtttgttacatatgtatacatgtgctatgttagtgtgctgcacccattaactcgtcatttagcattaggtgtatctcctaatgctatccctcccacctcccctaaccccacaacaggccccggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaactcatcatttttatggctgcatagtattccatggtgtatatgtgtcacattttcttaatccagtctattgttgttggacatttgggttggttcgaagtctttgctattgtgaatagtgccgctataaacatacgtgtgcatgtgtctttatagcagcatgatttataatcctttgggtataaacccagtaatgggatggctgggtcaaatggtatttctagttctagatccctgaggaatcgccacactgacttccacaatggttgaactagttcacagtcccaccaaaagtgtaaaagtgttcctatttctccacatcttctccagcacctgttgtttcctgactttttaatgatcaccattctaactggtgtgagatggtatctcattgtggttttgatttgcatttctctgatggccagtgatgatgagccttttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagtttccccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcgtctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttggtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtgctgaaaaaaatgtgtattctgtcgatttggggtggagagttctgtagatgtctattaggtctgcttggtgcagagctgagttcaattcctgggtatccttgttaactttctgtcttgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgcctttttttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgagagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcggctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcattcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcaagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaaatagcatttacattttggctcttgaaataactaacagcatgtcatttccaaagagacgttaatcattgataccaccagcagcaaatgttctcattcatcagaccacatttgttttacacgttcctctccttagaaagagataagtatggtttcttttctttagttcttgctaataggatacccaacatattgaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtagtgtatgtatgtgcatgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaattcaaaaatcagtcaggcatggtggcacatgcctgtaatcccagttacttgggaggctgaggcaggagaatcgcttgaaccacgaagtcggaggttgcagtgagctgagattgcgtcactgcactccagcctgggcgacagagcgagactctgtctcaaaaaaaaaaaaaaaaaaaaaaaaaaaaaaaaaaaatttcagaagtcccggagtcctttccatgatgcatttgaagggccagagagatagaggcatgccctatgtagtacatcttgctgctgtccctcgtgtgtttaccctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcgcgcacacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtgcaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcgtgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggcagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacatttttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagtcttagtattttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaacagcctggttcatttttactgtgttgccattggttaatgcttaaccagattttgtctctgtttcaaaatcttgaaataaaagtggaacaacttccaacatgacttaagaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccgttaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataataatcaaggacttagaagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggttctctatgaccttttagctcttaagtagtctgtcctggctattgtcaaccatgtctttttttccttgactgatagaaactgtggcaaactaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacgggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagccaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgtttaaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctacgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgactgtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcgagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttgtatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttccttggagaagttagggaaatgttcacagagttagagacatttgagctgagacaatataaaaatatagggcttggtagaacgtgaagagagggaaacggcattgttgatggtgaacacagcatgagcaagggttcagaatcatgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctccggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggcctctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaacgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggtttttttttttgtttgtttgtttttttttttttttttttgagatggagtttcactcttgttgcccaggctggagtgcaatggcattatttcggctcactgcaacctccgcttcccgggttcaagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataactttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggcggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggacaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaattcgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattaaccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacatactttttgatggcattgtttgtttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaatgcttttctttatcaatgttgaatattggcccccattctcttctggcttgtagagtttctgcagagagatctgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgacctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaatcctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcattacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcatatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgcttgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgcgcctgtatacatcagatatatggattgatgcagtgtactctctctcccttaatatgtgtgtgtgtgtgtgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatgtattcttttgtagtgttgcttacgttttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcccaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatggtctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacaatctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcctggcagggttatcttacgctattgaacctcagtttctccatttatccaatagagatggaaagtattggcctgcatttatttctccttcaaatgacatattgtatagaagcgtatcgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaaaatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacgattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgatttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattacaccatagcagtccagcctgggcgacagagtgagactgcctcaaaaaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagacgatctctgtcagttttgcctaggacgttcagtgggacttgggtaggagactgtggactaatctcacctctggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttactgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcacagaagcctaacgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgtgagttagatttgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcacatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagacagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgaatacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcacacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgtttatggaaaaggagattaaagaatgcagtgtgggttttttttcgtggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctgtgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaaggtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacacttcctttcacgtttgtaaactagttatagatttggtacatgtagtcagtcactgtgctaaattctccttaagaattacgtctcttttttgaaaaactaacttttaaaatagacattattattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatgcatgtgtgtgtgtgtgtgtgtgtgtgtgtgtgtgtgtgtgtgtgtgtgttacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccatttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttgcaagagtccaatgctgcataatattaataaacttaattttcttaaattttcttctctggcagagaccataagcagtatgatatttagtcatgctaggataagacctgagtagaaattgtactagctatccagctcgtttgttaatttacttttgatgaggcagagaacggtcatttaaccagcttttgttcagtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaatattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgatgagtgggttgggattaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatatgctgtgtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtacgatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaacaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtaaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacattctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatataggtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacgctccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacatacaggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatgcagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcaaactgcctggcatggtgcgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaggctactcctccataaatagaaaagatctcttctccaacacatcaaaaacattatttttaataggaaaataacaaataaagaacaggttaaaaggtagaagtttctgtttccccaatacagttttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttataagccatcctagggagctcatgaatttcatgagtgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaatggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccgtggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcagcagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggtaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattgatctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcatttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttgggatatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacgcggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtgctcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatcgttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctttggcttttccacattaaatttctcctcttggtttatttttcagagtactctatgacctacctcatcctatgtagcacactgtatctcccactgtcctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcaatctcggctcactgcaagctccgcctcccgggttcacgccattctcctgcctcagcctcccaagtagctgggactacaggcgcccaccaccacacctggctaattttttgtatttttagtagagacggggtttcactgtgttagtcaggatggtcttgatctcctggcctcgtggtccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccccagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgtttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctccttcctttccctcccttccctcccttccttccctccctgccttcctccctcccctctctccctccctccctcccttgtccctcttgcctgaacttcatatcagtgtgtcttgaatatttgaaaaatatttataggaaagtgaatgaaacctatcctaaatggagaagtagatggcaaaaaagggtattagagcttggcttttcaattgtaattgtagccatgacctaatttttggtaatctaataggcccatataatctctgcttggtgttagaagggaagacctttcaccttttgtgttttcttcctaatgtcatgcaaagtgctagagctttggagcaaaatgtttgatttccaaattccaattcttccatttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtttcaatgagccaaggttgcagtgagtgccattgcgctctagtctgggcaacaagagcaaaacccggtctataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggtgttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgctttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgaggctctcatcagaaactgtctggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctctttccataaaatgatatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacatggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagaaggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacagttgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagaaatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccgtccgtccttccttccttccttccttccttccttccttccttccttccttccttcctctctctctcttctttctttctctttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaggtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttggagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatctgaaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggttgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcactgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtgcagagaggtttcaggttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttgtgtgaacctgtccatgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccaagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgcgcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacagtagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaagaaaacagaggactattatgttactatttcctaaataaagaccaatatgataaattccttatattcagtgagaggaaagaagttgcttaccgaatgtactgatatatgcttccttttttcagaaaacaacaacatcaaccaaaacacctgtataattattacatgaatttttttttttttttttttttttgatatggagtttcagtcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatgtcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgggccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttaaaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtaggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaatattggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttatggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacacacacagacacacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttaattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatatgtgtgtgtgtgtgtgtgtgtgtgtggtatattatctatttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgtgtttttttttgttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaataactaccataatttaaaaatgcaaatgtagcaatgcactaaaaaatacctttagcttattttttgttaagaaacaagtgttttgcataatcagactttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctcctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaacggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggctttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagaacccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaacatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagacacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcgtaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgtaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggtcgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtggttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcacagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaataacaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaaattaaaaactattacattttttctccctcccttcctttctactgtttccctcctctcctctctttggtttccttccttcctttgttccttcgttccttcgttccttccttccttccttctgtccttcccttccctccctccctccttcctcccctcccctccccttccttcttctttcttgccctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcacttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgcttttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactctcattgggggttgggggggttgggggtgggctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctacttgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaactaggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgtaatatgtgacagttccctgggagtttctcccctcctcgtaggtatttttagcaaaatagtccttaaacattgttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcgtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataatttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttattgagtttcttccctaatttagatctcaagttttgcaaaagaatgacaaattcctttatttaaagaaaaatgaaagcagatctgttaccttctgtcctatgaatgccaattctctatcctggataattagataaataagatatgtataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttacaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgattttctgtccttttatatttcctccttccctctgagggttcacataggagcctccacagccagaggattactttcagaattggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaacgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcattttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcactggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaattccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatatacacacacatatacatatacacacacacacatatatatagcattcttaatctcatatatatataatatatatataatatatatatattatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggtttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcaagttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctcttggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcattttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtctttgaattaaagcaacagggcacaatttcaggagccattgctttcttctaggaaatacctcactattagagctctctttggagatgagaagatttttctcaactttattatgaattccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttggtctgtatatcttgtttttcatgccagtaccatactgttttgattactgtagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatatcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctaccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcaccatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcaataccagtaccatgttgttttggttactgtagccttgtagtatagtttgaagtcaggtagcatgatgcctccagctttgttctttttgcttgggattgccttgtctgtacaggctctttttcatttctatgggttttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaaaaaaagagagagctaacatcttcactttttaaggaaatagacattgcccccatgattgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatactttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcgaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttccctttccctttccctttccctttcccttcccttcccttctccttctccttctccttccttccttttccttccttccttccttccttccttccttctctctctttctctcttctttggtgtgctgagaataatctgcagacagtgactctacagataagattgcaaatattttcccttccttcattccttccttctttcctcccttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaataaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagaaaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcattgtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatagtcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagaccccatgttgaagaataagatacatatgctgatgtctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaacctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccatttctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggattgccattaaaataattttgtgcagcagcactgtgaggactcagaatccagaagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcaggtgcggtggctcacacttgtaatcccagcactttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgtaggagtcaggttgcctataaaggcaaggatgtgcatacagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacaatctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggtttttttttattattatataaagccttgcagtgagtcatagaagaaatgcactggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaaaggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataattcataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagatcctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccatttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagtcgtcttgagacaataggttgaagctttcactacatgttcttttagcaaaaaattataaagcatagaggttgagatgggctctggaatcagactacaaagattctgatcttactgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatctctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacacaccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgttaaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcagctcttaccagtgacttcagtgcttccttatacaaggtgcaagcggtgctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggcattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcagatatgtgtcatcttaatattcctattaaccttagaactttgtgactgtgttgggattacttgacatatttgtttatcaatcaacacagtgacagtgacaacgaatgagtaaccagtgttttgtttttgaaacatttgaagaagtgttccatatttctgaagttattagtttagtttaggttagtttagtttagtttagttttaacgacagagtcttgctctgttgcccaggctggagtgcaacagcgtgatctcagctcactgcaacctctgcctcccaggttcaagcaattctccctgcctcagcctcccaagtagctgggattacaggcacctgccaccacacctagctaattttttgtatttttagtagagatagagtttcggcatattggccaggctggtctcaaactcctgacctcaggtggtctgcctgccttggcctcctaactgaagttattttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtagcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacatcatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttgaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactcttggtgttgtacatgttgtgggctttgatgagtgtgtagcatttatttcccgtcatagaatcatgcggaatactttcactgcccctaagaattatccttgctctgcctattattactttctcccccaaccccggtaacccctgaaatttttactggcttcatagttttgccttatcagaatgtcttatagttgggaccctacaatatgcagcctttccatattgccattttactgaataatatacattcaaggttcatccatgtcttctcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttttgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaagattgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggattggggacacctgttacagaatttatactgttaaatgtcacttgatatgcacactaaacctattacaaaccacatattgtcacttgtcataattggacagagctgcaatgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccttcttcttcttcttcttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttggtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggaacagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccagcatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaagcaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacattatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgatgtgaaaacttagcttgtccagccaaactggaggaaggagaggcgggacttattggagtaactgaaaagagaaaaattggaatatgagcagtaccaatactcagtctcttaaggaagggtagagtccctttctttctgtctctgtaatttttttcttttttgtttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcaattggttttgttaacactgctgcaccgaagctctagctgaattcacataatctcatgattttagtaaaggtaacaaaggaaaacgattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctcccacagcattagccttagttatgagtataatacaaaagaagaggaccagccctgctggaaggtaaatgaaaagatggaggaattgaacgattacataacagctgttcagacttgtggtactgattagagtcatttgtagagatgaagcagtgtgtcaagccagtgtgggctagggtatactgggaagttctcacagacagaatgaagtgggttgcggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgtgtgtgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaaatatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattaatcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccgtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatggcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttccctttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcatcttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtaacaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatacgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaatactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcagacatatggagtttcaaactaacactgtggtaattgttgtgtgtctaaacaagtgacaacggggctgggcagcaaaactagacatgggagaagccaactgatccattgagctgtcccagcaagagttagtgggattatgatttatgaaagacctgtgtggacaaggtagtttggaggaactgaatggagggagtgaattaattagaagaatgagacaggactagccacaaacttctcctagaagtttaaactattttaaaaataagagttgtggctcatcaaaaaagtagtgttttcaaaaaacacagccccttcacttaaatgatacgcacagtccagatagactgcaaaacttaatgtttagaagctaacaactttttaaaaactttattgatctgatctgtactgagaacagattttctctgtgctttataataaaacataaagatcaatcacaaaataatttatcaataaattttaaaacaaaaattttaaagtgtatgtaaatatcatataaaattaagaaaaaatatgtaagaataatatttgcaatgactatgataagcaaagggttaacaactgtatgaaaattttcatgcaaatacaaatatcccaacagagaaagacaaggaatgtaaataattcttaagtagataaatacaaatggatatttaacttaaaaaaaattttattcacattagtatgaaaagaaaatttaaataattgaaatctagtttttcacttatgaaattagcaaagatttaggaaaagaaactactgtcatttgctgctggtaagaccgtaaattggcccaaaacttttagaaagttattttacaatatttctcaagaactttaaatgtctcatatctgtcaatccagacagatagatggatggatggatggatggataaatatcagatggatggatggatggatggatggatttatcagtaatagatacatagatggatagatagatagatacatagacatctatagagatatatgtttctatataaatatatatctatattatcctaaagaaatatatatttgaacaaaatctatttatgaaaatgttcactaatgcaaaacttataatggcaaatagaaagggaatctgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtacttcccaataatcagattacatgtgattttattttcccccctaattttccttaattttcaagttccgtacaatgaacatgtgttattttcataagtataaaagacttttttataaaaagaaatatatagaactaattagccaaataggaaagtttctaagaacaagggaagaaatttgtgaatggagtggtgaagagatccttggactgagagctgggcaatgtggatactaacactggctctgtcacaaagaaacaaggagacttattgaggttctctcttctggctcaaagattttatgagccagtaatttatcaaagagcccatcctagtgtacccatgggcctgtcaaccctggtagacaggttagtagcccagatgaaatttcccgtggatgaattttagaactccgctccattgatcacccttttttgttgttgttgttcttttactcttctggaagagagctaagaaacttctgataccatccccctttcccactcgccctcagttgtgagatggaggcagcaaatattcagtgtgttctttttggtcttaagtagttctagactcagataccacctcagcaccaggctgagtttgggctggctttggctacggtttgctgctgaatgtatcagtgatggacttttgaatgtttaatagccttagggaatgtggcagtgtcccctacatagagaactgtagattctttagtccaccatttccaaccctgtgatttagattgtcattataagcatcacaggatgccctgagttgagaaaaatctgtgctgtttaaatggtctttaagcagcctttcctttctcctctttctcagctctattctgcttaggatatggcttatgccacttaatcaacatgctatcatatgctttctgcattccagacatatattgaaatatcttggttgttatagccatcttctcccacatacatcccctttctctcttcccctctacatttttttctgttacttgttatttttggtactgatgtgcttttatttgagtaggatattggaatgcaattgtcttcttagtccaccatcccctgacctgtcattattgaaaaacaaaattctgtagcaaatgagtccccgaaagtgttttttttcaaatgatgatgatcggtcacgttgtgaatctgtagactcctttgcgaaaacaacaataaacacagtattatttatggtggatatgctaggtacatccaaagctcttcatatgtgttgccttgtataatttcctcagcaactctaatttaatagaaactattgtccatgtatagatgaggtagtttatacccagataggttatacaaacctgtaagtaacagagccaaattttaaaggcagacaatgtaactgcagaaaccttgttcctaattgtttaatggaatatggtttagaattctgtgtggagaatcttactctaccctagtggtaaacttaaagctctttaatttactgtggttatattatatatgtgcaatggatccctattttcaaacatagtcgtttgataaagtgtgggctgcttttcatcacgaatgtaaaaagtctcttagttgctacacccagcaactaagtgtcctttaattcttaactttgaatacttaattggatccctggtgctatgtgtatttgatttttgttgtgaaagttgcattcactgtgtccctttatttgacatcagcaagatgtaatttctataaaccaattaatgatgcacctttcaactcttactatgagaatattagctggtgtaaatatcggactccttgtgaaggatgactcgctatctgattggtctttaaaaaaatactttaggaaataatggcttgcccctgcatataccaatttgaagtctttctaatatcagccattagctgggatccacatggagtacatagacaaatgaccatagtttctactgtaaaaatgcctcaagatcttgtaggtgagattaggcaattagataaatgcctatagcacaaaatgaattaacatgattgcttgaaaagaattaatttctgtaataatttgaagaaggaagaagttatgtatgctttggggggtatacagaaaggctttataaacaaccctatgaaaaaatggaccacagttttaaacgggcaatccacagaagggaaacactgcaatattcattggaaaaagaaaaggaaggaagggagtgaccaagagaagaaacaagaaggaaaggactgaaatcttgtttgcctttttggagaagatagcatttgaaatgggccttggataataaggtgtgattgtcgttggtggaaatgaattgcatccagaatgcagaaataactcaagcaaaggcatagagattggaaaacatggggcaggtagaaaacaagtccagagtctttgctgcttcttagaagatgtataagggttttattttatagttttataatgaagggcttttaatttcaagtgatgggtcagtgtataattccttaggagataaaattccagggaaaaggaggaggggttataagataaatctagaaatctaactcataaaaattagttcccttccagggagttagttactccaaaaatatccttgataagctaactctgcatggatataactgtgttatctgtgagctggctacagacaagaatttacaattgtctgtagttgcagtctttgagctgcagtcattcaatctctgtctactgctaaaagccagagtttggaaagagcccttatgcatgcttgataatgacacaatttgactgagaatactgccattttataataatctctgaaagttacttccttggtctactgaatctcatattttgtgaagttaaatgaccaatgactgtcattcattggccatgattgtcttgagtttgttgatactaaggtgttatttataatgtgccttttgtttctcaagaatatgttcgcagaaatcaccagtagtgttatccatgtgtatggaaggccagactgtatccccttatgtactaacagactgtatggcaagaagggagccaggttgtcaatgtgagagctaatgttgatatcaacacaggcatcagaaagtcaattactctgtttccctagtttactaaatggtgcttttgcaatagggaccatgttgcctaatgggctgtgaactttaatttgttcataacagtgccaatgagtaaatggatctacctgtggactttagagtgtacttctaacattttaggactgcaagaaagtagtgtgttttatcctctgatacattcatattctctattggagcatacctatccaagcccaatatcctacatcagttttaataaagagaaattacatttaattgtgtctctatcctttcatattaatccattatgaatattttattccacaatgttagaaaaattacattaacttattagtgaagaacattcttttataagaagtgctttatacttcagaacctcataacttactttaaatatttcaggcacaataactggtaagagatgaaaaataagcctgaactcatagggtaaggaccatttagaagtcttttgtcttcagcttgtgattgttcagttaaacttatttgatgtgtgctcagcaggttgtaaaattcctatctttctggagtgatccataagagattacttcatagtgaaacacttaagtttgattcttatgagttgcaaaatgattttccaccaggaaaaataaagaatatgggttccatcaaaagtcaggcatgaattctcatctcctgataaaatgtgaaatatctttgctgatcctgtgcctattctcagtttccatgaccatgcacaattattatttttagcaaataagcaaatttgaggcaaaaacattaatttgataagatatctgcaaatgcctttctggaggagaaaataaatttaaaaagcatcagtgtgtttcactgatatgcacaatcccccacttcttataagaaattaaaacactagtttttaatatcttcagagagaaaatgagtaaaggaagcacagtattttccgaaacgtgttatttaaactaaaaccatgaaatttatgaaaaaaaaaaaaagtagacccttccttgatacacttggtcccaccgaggttcaaagtttcctttgaattggggggggaagggagattctgtaatttaagttttaaacttctgtctttgtatctatccttgtgctggtactccgctatcttggttgctatggttttagagcaaatcttcatatcaggtggtctaagttctccaactttgttcctcttttccaaaattagttgaactattgtgcatcctttatatttccatatatattttagatgtggcttgtcaatttataccaataaaggattctgttgtacatgtaaaccaaattagggagaactgacactttaacaatattgtctttcaatgcatgaacatggtatatctctccctttacttcatttttttttttttggttctctcagcagtgtttttaattattattgtaaaggccttgcacatattatggaacaaacacatattatggaacaaataaatgtaaaagctaaatctataaaacttttccaagaaaagaaaagaattcttacaaccttagataggcaaatatttcttaaggagtatacaaaaaaccccacaaaccataaagttaaaaatgataaatttgattttataaaaactctaaaacttgttttttaaaagacaccataacaaatgaaatagcaagtcccatacagggagaaaatatgtgtacagtatgtgtatatgacaaagattttatgccagaatatagaaataattattaaaactcaagaagaagacaaagaatgcaatttaaaaacaggcaacagatttgaaaataggcaatagatttgaacaggtacttctctaagaaaatacacaaataaccaataagcaaatgaaaaatgctcaatatatgtagtcattaaagaaacaaaataaaactctgtaaggtacctccatacattgatgagagtggctaagactaacaataccaagcattagctaaaagacagagcaattgaaattctcatacactgcagttgaggatgtaacatggtactgccactttggaaaacagtttggtagtgtcttaaaaataaaacgtgttcaacatatgacccagcaattctcctccttgacattgacccaagtgaaatgaaaccttttttttacacaaaggcttgtacacaaatgttcatagcaactatatttataatggccaaaaactggaaacaacccaaatgttcattaacaggtgaaaggacaaattatgctatatttatacaatgaaagatgactcatcggtaataaataaatgatctgctaatatgcacaaatacatgaaaaaaatcttaaaaatatgatgctgaataaaaggaaccagagctacctccacccctaaaaaagactgcctaccttagaattatatatttacaaaatcctggaaaagacaaaactaatctatactgacacaaagcaatcagtggtttgctgaggctgggagtggggaaaggattgattataatggggactgacaaatagggaactttttggggtgatggaaatgttccagatcctggtaatggaggcagttacaaagtcttataaatgtattgaaattcatcaaagtgtacagttaaaatggttttatttattgcatttagattatacctcaacaaaggtggttttaataaataaacaagaaaaagtgtttttcaccaattggtttgaaattcggccaaggcatatttgagcgagggctgtcagccttgtatttgttgcaagtcacagtgagtatgtcctaatggatcctctacaaggtccaggttaggtttctttaaaggatggcaagaacctgaaacagtgtgagtgcagagaacagtgaaacagtgtgtgtacatagtgctttgatttttgtgcattttttggtcctaatattttaaagtttgctgaaccatacctcatagaacatttacctgctttttctgagggaaatatctttatagaacttttccaaagcattctgcatagattttattttaagaaattaaaacattttatttgtattaatttacataataattggttaactcacataattacaatgacaagatcatacagtaggagcagacttgggatcaaatgcagctgactctaatagcaggtgtagcaggaggcacacagctgaggggacatttgagacgaaattgaggccaggttccacttcacattgtactagggttaagcgtgtccacccagaggaagagaatccttaggcctaaaagagcaaaagtgtacagacatactcaagagtaagagagtagccaggaacaccagccaagccataaactccagtctgtgtgtgttaacagataaaattaagagggtaatctagggagtctattgctaaatgaagggcacattaagtctcaacagtattcctatgatcaatcaagcaaccaatgaagtgtacaagcagaagtgatttgtcatggaatttcagagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtggtaagaggccagttttcccatcctcatttactctaaatttgattcatagattattgagcctcagatatctgtttgccatctggtctggtcagtctggtttggcatgcgtcttctttctctttagagtttgatgacgttttaggctgtgaggggcatttgcattgtagtagaaattggatgatgtcagacttgctttatcacactttctcaataatctcttttggtgagtttgatattctacttacagctgctaaagctccttataaccatacgcacaaacatacacttccatatagtcatacatactcacaaacatatatacacagccatttacttacacacgtgtacacaaaggtgtatatccacacacttacatgcacaatgagagatgcatagtaagaatttttccactacccctagtttaactggaagctgtagaaaatctgaactttattatattgatctctgggatcatccacaaaattgcccaaaatgggaatgcggaagctgtttcttacctttcattttctccacatccaatgtgtcctcttcaactgtgtattttgaaacaacctttgaatctgtccccttcccgcaactgcactgccaactgctgatatcattttttgcaaacaagtgtaatgaaaagagcatattctttaacatcaagcaaactaaggtgcaaattttagctctgcatgtattcattgtgctatcttggacaagttatttaactatcctgagcctccttgtcttaatgtgcagatagaagaagataatgcctacctgataggtggcataggaaaaggtcaaaaacattattttctactcccattgctccccttgcctgaaacattataatggccaaacaactggcctcccaacctcctttcccctcttcagtttttcctctacattatagctagagattttgctaaaatgtatatatggtcatcccattttttacttgaaactggtatcttcctgcctataaaacacattttgtttcttagtctcacataggaaatcctttttagtctgtcttgggcccaggactccagtccgattttcctcccattcctacctgccctcttggttttgaatgttccacacaacttcattcctttctctgttaattggcttttcctttacttagaatgctttcccccttcctgctttttagggagaacagggtaaactgttctccctatccttcattgagtctcctttcttttttctaaagttttttcttatcagcatccctcccccaatttgagctcattttctagaaagaattaatagctttcttatatgactctcaagatatttctgtgtggttctctaacagccttcatttattttatatggtaattatagatgtccatttgttctagggaaggcaggtgtcaggtcttactcatctttatattcctggtttgacatacagtgcctgatgtctagtaagcacttgatatctgtttattttaatgtttatgccctacattatctatcacaagtattaaagattgataggtgctctgtaaatgttaaattgagttaattattttcaatcttacaggaagttacataagtcattcctgtattcatttgtgaattttcgacatcctatattaagagttgcacttagaatgtgagttccatgagggcaacagcacttctgtcttactgctctgtctgctatgttggcccataattaaccactcagtaagccttttgtgaaaacaacctcaatgagtcttctacctcaagtcttttgaataggaatggatttaaagctgacccctaatacatctttcaaactttaagtcagtaaattttttacaaacttttttaagttgataaatccctcagaaattattctgaggaagctgatgggatagaaatgaaacagactaaggggctccaggcaatcaccactccccttcgttctccttcctctgttggtggggatcaatagagcaggatcctcaaaactgtggagttctttggagcatactttgaaagcctctaattctattccacgctctaatttccaaaagagggaactgaggcccgtggtggttaaatgccctttccgaggttacacagctatacatggtagagccgacccatgtcttctgactctcatcccgttgcacttacaactagcctgcatgttccccttttcccatatcgcatggatagcatcttacgcatctaagtttttttctttaataatgatcttctcttttctttaagagacaccatcactccgagttgtaccacttgcaccaggctaaattattcctcagtgtttacccctttcagatatttatagaccatcattatggcactccctagtcacctgtcagcttcctaatatgtacatatatggtttctttaatctttctgtacagtcggcttctctagtcccttaatcatttgtaccattctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgtaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaagaaaccgttactgagcgtatccatttttatgcagtttctgtggacttacatggtttctgggagctccctataagccttagtaagggaaagctcttgacttatctcactagttattagggatttggatatatgtttactaaatgtgataatctaagtatggaaactacattagtacaagaggaatcacccagaaatactctactggcataaataaaacattacctattgcccagttttctcatttgtttcattttgtaacttttataatgtgtcaataagtttgaagtcttgaagggctgcccagaaaccaccacagagtggattttccttaccctcaatctgccttcatcaaaatttagtttgtgtgtttatcctataaaatttatctcataataaaaactgaagactaggacggtccttagaaaaacacttgattcggtgtatttattttataaaagggagtcacagagagaaaatgtggccagctcaggtacatggcttcctaggcaatgttccatttcgcaaaactttcattggtccagaaagtgtaccttcattcccaaccaaatccttcctataatgctttccatgcctttcttctgtggctctctctgatgatctcacaggtctataagctcttacaggtagaaatatgatttcttgctgtgttcttattataaagcattgccatgcaactgagaagtaatgagagccagtggattttattagaatggaattttaacttttctactttaaaacccagtgattctgctagtctggaggtagcaaagaaggatgactattttctctctcacacaaagtaagattctgaaggggcttattctctgaatgaaaaacgagaggagaaaagtaagaaccttctaatgttttattcaaatgttaacaaagaaatttgagaagcatgtttccttaaaattgacaccatttttatcccaaacattctggtaagtgatagcagatgactgtgcaagcttctatggagagagagagaggaatttttccaggagcatagtcccagtgggaagtattacctaaaagtaatacactaatcactttcaatcttgcatatttccacatactgtgtgcacacatatgtgtattaataactgttccctagacgtcacttcagcgctcagacagcttagtgttgctatgcgaatgctggagatggaatcagatgcagactacagtttagcaatgagaattcttcagagatacaagaatggaaatggccttaggtcctgcctcatgggtctccctctgagctccagtgtaacatcgggtgtcaagtatttgtggccccatctgcccactccactgagaatctaaatggcattgccagtatttgtgaggtactcatatcttaaaagtcagtgtactcaaatcagtcttgcattctaccttgtggattttgcatggaaattttttagaatgtcattgctgatggaagccccagatatataagtacatctgctccatcgtactggtgatttttatagatattcataagaaaatttattttacagcagtttattttagaggaattctttgcattttatttgtatgtgtgtatacttattttactggcaggatacacacacatgtatatacacacacacacatacatatatacacatacatacatatatatatgaatgtatgtttgtatcctgtcagtaatactttgaggtacctagggctgagattactatttctcttccacctatggctcaaatgggtaaaatagcttactcaaagtcacagttcatacatgtggtgcagcttgaatcaaaactcaattcttctatccacagatttaccactacttgagtagtctgtggtgtttaaaaaaaataataaacaacaggccgggcacagcggctcacacctgtaatcccagcactttgggaggctgaggcaggtggatcacaaggtcaggagtttgagatcagcctggctaacatagtgaaaccccgtttctactaaaaatacaaaaaattagctgggcatggtgacgtgcgcctgtaatcccagctactcgggaggctgaggcaggagaatcacttgaacccgggaggcagaggttgctgtgagccaagattgtgccgttgcactccagcttgggcaacaagagcaaaactctgtctcaaagtaataataataataagacgaagaagtaacaaagccaaactggaaagtttctgttaaatgaatgttctagataataccaacgtataaagcaatcattttataccagctatggtcaaacagggaccagagccttgacttttttttgcctcaacacagctctgcagaacccactcagtaccccatgtcctactgccattcctttggtttccagaacattgagatgtacaaatccaaaacaccacagtgtttcagagagaaatggcatgactctactggttgcaattgtaatggagttcaccttgttctggagtcatacagaagccatgttgtagacttagtgtcccacgcaatactcctaattacaatgaaaatctactgttaggtagaaggagaaattcctcacaatcaggcaacagcgcctactagtgggaagaaactgatacttgaggtagggcacctgggagatagctctgtgcatcttgagagagtgctacactgagagcccaaaggctctcaggtctcatctctcctgacagcttgctatgacatcttaatcaatgaattgcctctctcttaccctttgttatagagtctgtaaatgaagagtttggaatggctactttctaaattttctacacgtcctatgacccttgaaatcctcttaacaatgtattatggatactttgctactaaacggtaaaacagaatcccgagtaagatgaattggcttcctaaggaagtagtgtcaggggagaatagcaccatctttggggccagttccatttatgcaggtaatatggtatggtccagctcaaagatcactggactgggctgagttgcaactctgctacctacttctcaagtcatgtacaaggtcattcctatgttaactcatgtgttgggaagatgataattgtctcatttagcttttagttattataagattcatatgagaatatagaaattatgaagttttatgtgaatctgcaaatttattttcagtctttatatatcacaattttaatttaggctaattataatttttattttcccctttttgttctatattctaaattcgtatctcccatggaggcaggtactgtatggacaaaatcttttattagtcacatattgttttcatccattttgtgctgctatagcagaataactgagactgggtaatttataaagaatgaaaatttattttatcacggttctagaggctggtaagtccaagatcaaggcaccagcaggcttggttttctggtgagggctactctctgtttccaggatggtgctttgtgctacctcctcacatggcagacagtggaagagcaagccagcagaatgccgcatgaagcctctttcacaaagggctttatcccattcatgacagagaagcccgtatggcctgatcaacactttttaataaaatcacaatatctactgctgaattttggagggaaccaattcaaatcatagcacacatcttttctaaaatggaaagggtaatatgatcattggagaaatactcattcctttgcatattggtttactatccaagccaggtgtggtggttcacacttgtaattccagcactttgggaggccgagatgggtggatcacctgatgtcaggagtttgagactagcctggccaacatggtgaaaccccatctctactacaaatatcaaaaaattagccagccatggtggcacacacctgtaatcccagctactcaggaggctggggccagagaattgcttgaacctgggaggcagaggttgcagtgagccaagatcgcaccactgcactccaacctgggcaaccgagtgagactccatctcaaaaaataaaaaaaaaagtttactatccagagaatcttgtccaggttaacactcttttttgtctgctttcttcttttgtgaaacaagaaggtaagagggacactggagaaaacctaatgttctttacaaaatgagtcatagttctccatctgcaaactgtggctcccatttatgtcttggtgtcaatatgactattacatgttatgtacatggattccacctcatttgcaacatagtcttctgcctgagctctgtttgttggatctgatctaactttacatggtcttaagtcacacattgaactcttaagttctgtaggcctctaagcctttttaagttttagtattttcatcgttaaaatgagagtgattataacccttgctttgctgcctccaaatattattgagggatcaaatgcattgataaataagataaagcactagacaaatataagggatgcttgatgacttcacagagggaagattattctgttgctggctgctgaaatacagtagctttagaaaaacccctttgggttcccttattatcaggtttggtctcaaataaccagaataaatttggagatttcctaccacaaaagctaaaagtacctgggcagatttaccctttgagtggacctaagggaaatgcagattcccacgggagagatcacggagcagattcaaaccataaggcaaaaataattgttgcaatagcggttctaactgtactagtaaatattgatttttctgttagcagatcaatcatgaaatgaattctaaatatagaagactggttaaaaaattaagacggagaatgtgaaaatgtccatgtgtaaaaattaacttaaagagaaatcttgctttggccaaaagaaatactactgtttctgtcaggaatgttctgtgatttaatcaagtttcctgcctggccagataattttaggaattgtggacttttaaagtagtaagtcagtttagaaaactggttaagtggacagatgtaaagtcagactgcctaagccccaattccagcttcaatatttaactctgtggttgtgggcaaggcacataatctctttatgctgccttttcatcaactgttatggagataatgatagaacctacatcatagagttgttggggtgactacatgagataatacaattaaatacttaacacctggtccataaaaagcgctgaataaatattgactattatcatcaccccggggtctacaaatttttgtaggattaggattaggattgaaatttctaccgaaaaattccatcagtaaaatattgataaatataaatcttaaccaactgcctcagagacatagggacctctattttccactcattgactgtcatctttagagaacagtccaaagcatgtgcctttctgttctagttgttatgagctctttattttgaagttgaactatatacttcctatagtttaaaggagaaagaagtaggtctcatgctggacaccttctagatgttacctcctccgaatttcatagccaagtatttaaggcagttatgatcatctccctcttagagaagcctagaaaaggttactgcagtgcttgacagcaaatagaaactcaccaagtgcatttgttgagggattgacagaatggctggataagtgactcaactaagaccacttatctagtgagtgcgtctactcagctgcttgttttgaagacaaggaaattcgggctcagaaaatttaggaaacttgtctaggctgccaatagctagtaacaaaggcaagaattgcatatctgattttctttacaccatgttacatctaactgttcaaaagataaccatgtattatactcgaaaatgcaaaacagggttgttttttgttttgtttgttgtggtggtggtgatggtatttttgttttgtttttgctacttttcctgagagtggaagttgttatcaaaaagttactgtcatgactactatgtgtatagatgctattagtttcatcaaggttgggaatagggtatatgttgcccaactttctgcccctctccgcctcatattaaagttccagtttcctagaatatatctcctgggagatttggcactagccatcactgcattccaataccccgggacaaactactcttggtggaacacagaagcatacagtccttgttacagcagtggttctcaaactcacattcctgatggaaagctagagttgaagggtcaacacccaagagctgcagtggaggaccatcacctgtcctgattcgccacctgtggtagatcatgactttcactaagatcccctgaggcttgtggggatggagaagtgatgctggactggcccttcctctttccctgcaggtgttaatgggttctgctcctaaacaatactgatataggtcagagttatgattgaattgtatacatagaaacatgtgctgattgagaaaatgggctttacaagtcagacctggttccagtctcagccacactacattctgcctttgagactttggccaggtgatggaacatcaggtttcttatctaaaaaggagaataattggttggtaggactaaatgaaaaaatgtatgtgaaatgcttaggacagtgctgagcacagataaaaatgcacaataattttctattttttgttagtttccttcacaatacatatatttacatcagcgaaacatgcttgcttttgcaaccttctgtgggactccccctcctaatttaccacctcacctgaaggtctaagctaagcaaatctctgtctataaatgaatcacatcgtggttagactttataacaacttccccttgccaggagatcactcagccttcacttcatctcatctggtttgctgcccaggcctttatccactcattcctgaactcctctccctgacaaccttggggttttggcttgttgtgtgcgtgtgtgtgtgtgtgtgtgtgtgtgtgtgtgtgtgttttgttttttgtttttttttactttaccttaatttctctttttggactaagatgttaaaatgtttcttaatgtgactgtctccgaaactgttttgtgtctaccactcatcctagtggcagtcattgatccttttcttgttgcgagtgtttgagtgtgggtgtgtgtgagtgtgtatatgtatttgtagagggaaaaacaagagagagggaaacagacattggagccacctttcccccactagccacgtacctgttgaaccttcaagcctctctatagaatcagatatacacaagcacagtgacagaactacatgtgtcctacagtccagcttttaagatatgataaaaactcttgtattcacagagctaaatggcaataaccataggagattgcatattgctacattatgtaaagacagagtcccaagaaaatagtgagaactcagtttgatgtatgatgtgatatgtgatatcttactttacatggctaacagttgacattctttgtggattctatattgtctaaggctacagaagagccatatgataaattcatcggcaacccaaaagaagcctgttctatcgcagtgcttccaattaatataagtaaaccactttctctggctcaatgctaccaaaatattttatgagaaaatttagctgattctgctcatgtatattttcaatggatggaaagccattgcaaacttttcaaactaaaatataaagatagcattagggagaatactctctctggtgaaaaacaacatgtattatgatgcgttaggaatttctttttttcagccaactcgtggttgagcagtctgtccccaaactgttttgcatgcggacgaaacctgtttgggcgatacttgtcagcttttcttctgacaagcaggacagaaataggcacccccagaacactgagtttgacttgactcaacatagaatcacctggagagttttaaaagtttctctcctgtaatatcccacctccagaccaatgaaatcagaatctttggagttgggaaccagggatcaatatttttttttttaagtttcccagatgattgcaatatacaggcaagattgagagtcactgtcctagagtataagcagtttaagaaacaagttgtctattattacatgcatcaatactacagagtccatgaaataaaagctttggtgataagaaaatgccaccatcctagagccttcagttaacatcatatgggcctgtcatataaagaatgcaaactcattctgttatctttttgggccttcagtggaagataatttttaaatcagcttaatggaaactgtgcttcaggaaaataacttcagtagccatatgtaggataaactggagcaggttttgtttctaggaatatgttgccatcatttcactacccttatataatcttattgattcaacttttagaaccaagactttttgcagaatatatcgaagaatgtgcttaatgggaatgctgatatatcatacaattggcatatagagcttcagttcattatcatatttaaaggtacaatattaattttgcttgtgcttaaaatgtctattataattcaagtagcaaggaagacataaagaaaaatgtgacctggctttacatctgcacatatttaatactttacatttgatggtgaataatgggaaagtttgggagtatgtcatgctcagtcaccatgcatcaactcccaaaatggctgtggacagctttggtcctgcctcaaaacaagcactgcttgcaaaagagggtctgtggcttatttttatcagttgtgtggtgatcacaggaaaaacattttaaataaaaagtttattttgccatcatgaaagaaacaaattcatattaccaaaagagaaaataaatatgacaacccagcctggtgcagtggttcatgactataatcccggcacctcaggaggccaaggttggagggttgcatgatcccaggagcttgagaccagcctgggaagcacagcaagaccctatctgtacaggaaaatattaaaaattagctgggcttggtggcgtgtgcctatagtcccagctactggtggcaagggctgagggaggaggatcacttgagcccaggagttcaagggtgtagtgaaccatgatcgcactactgccctccagcctgggcaacagagtgagatcctgtcacaaaaaaaaaaaaaaaaaaaaaaaaaaaaaaaaaaaaaaaaaaaaaaaaaaaaaaaacaaagaaaagaaaacccatatcacgctatgccacttctcttgttcaacctgtagatttccctggaatgccactattcacccatgccatccccaaaaatgacttgttaaaattctaactcttcagattagctccattattaagacttctgtaaagtctttctgttggtaagaggaggtaaatcagagatatcagaacaatcaggaagccattgcaatagcctttgaaaggaagggtgattaggtagtaggcatgtggtggaaagcaggcatttctgacacattgctgaggttgctatagatgggagagcagaggtgaaggataagaagaattgttggctgaatctagagtcagtacaaagcaatatataaaataagtaataatatataaacaccatttttggttttgtttggaaatcttaattcactgacaaagttccccatcggctgccggccctctgtcatcggatcttttgattgactgactgctcagcattggcagcaagctcttcacaccagccctgggtctgagctaatcagctgtgtttccttcatgctctgatgccttgaagtttggtactattctcctggtttctcttgtttaaaagtgctgagatacttgtctaaaagatgggccttaagattgtggtgtgcttttaataatgtgtggggtaagtgcctctagaggcaagcatacactatgcttgagtaactttctctccattctgaatctctccctaaaggacacagtttgtaaatgtttgttcatgtgaaaagggaagattcaggtaccttttctgtcctactgatgtgtggggctatttttatgttttgttcttcacttttttctgtacttgtgatttaaaggtgccagactggttaccctcaaggctagtgtccccactgtatcccaagaatagaaaaaataatgagaggcagcaaaactggcctgtgtctgagtccagcatattaggctgacccactctagaggaatattctccaaagcataaagtagaagatcattccttaggaatacaatacagtccatctgttttcatagctgagaaggcaattccgtgtcatgccatcatggagccactgcagtgttttggtatccaagccatagtcactcattctctccgtgagggaaaactagaatgtcttttcctcttccacctttacctttcaaaattccatccttgaaggttcggctcaaatgcttctttctccacacaacctttcctgagcccctgtgagtgtggttttccttccacattccatagcactttcttctaagacgtgttacatgctttgccatgtgactattgcatgtaggttgtcttgactgtgagaggcactgacatcgtgacatcgtcgaattcatttttgtatatcacacagaaggagaacatagtcgtgggcaagagtagatatttgaggttgaatagatggaccatttcaaagcttatcttttcagcctgacctttaaggctttgctctggccgttccctctaaatcagtgattgaagtttgctcccagatcctcatgagtagctatcaaactctccataagccatgtaggctcaggttcttggattccaggtattacacttcgggcatcatagtctgaatcaaaattgctacttttagctgcttagtagactgccattaccaatagtttaatgagaactacttttttaggggacggggggaagtgtggtccacagatccctgatagcccttcgtgtactatgtagtgaatctgcttgacatctagaaaagggaagagtaatatagaaaaagaattttgttgacctgcctgcatttaacaaatgtaaaatgtaaaattacagctttcacaggaatctaatatgcttttaataatcatatggattggtaatccatttactcctaatccctaattcgttttctgcaatgaaatgttgtcaaagggtggcatgaagctgttagaatttaagcatgattttcaaacatagcacattttttttgtggttttgtttttttggttttttttttttttttttttcagaataatttcaaaaatagtgccatatgaaatagttttgttactgttggcaggaaagtccaaaatgttatctcataataaaaacaggtacaagttcagtcttggataaaaacttttgaagtctgccacaaacaaatactatacaaaattttttcatcaaatgtcaagactgtggtatcaagactttataatgatatcaactgtagtggtgacagcttagtttccaatactttaactctttttccagcacttcatatttctttttggtttgagatgaagtctcgctctgtcacccagctggagtgcagtggcgccatctcagctcactgcaacctctgcctcccgggttcaagcgattctcctgcctcagcctcctgagtagctgtggttacaggcacacaccaccacgcccagctattttttgtatttttcatagagatggggtttcaccatgttgaccaggctggtcttgaactcctgacctcaggtgatccacccacctcggcctcccaaagtgctgggattgaagacatgagccactgcacccagccttcatatttcttattccttaggaaaaaaactaagatgtatactttgggttatatttaaagtcacattcaaatcccacaacaggatataaagaaatacttttcagggccaaatacaactggagaggattagaaataaatttacctttttttctctcacgttgaaacatctagccctcccatgtttgagtgtgaaatggctgtcaatccaatgtgatggagtgctgaaagccgtcttcagtgagaagtctctccataatgctccctaacatcagatccatgttaatcctgatgcacagaactgggaataggtaatatagcatagtgtttaagagcacagatgctgaagttagactgcttaggctggaatttagttaaccatttgtgtgactcagtttcctcatctgtgaaataggcataataacagtacctgcatatagactgttgtgaatatgaaatgagttaatatatctaaagcccctagaaaaagtctgacatatgtgaagcactacatttgctataccttatctatcaaagcctacagcttctggctaacattcccagtgttctataattattagatagaattttttttaacttagtagaaacaaagactaagaagggaaactagatgtggacgtgacgtctagctcaagattcccatgatggagccacatagagatatggatggcaaccagcataatgcctctcactgacataactatttgtctgaatttatattttattgttattatttaaagcttactgcaaattttaaaaactgaaacctgatgtccatatgtaggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggtaagcagttagaatgaggaagcactatggctcagtaggagaaagaaccttttagccatcaaagcgatctagaaattaaaggactgccttgggatctgcctgtcactgagagctggctgcagaggttttacaatcagggcttttgtaaaaggaactaaaatttgagtttggacccaattatcttacattctaactggatgtgtagaatctccaagaagaaagactcttctgtactgttttatagattttgccttccactccaaacatcctgagtcatgttccttttatacttgcatgtgagatgagagtcagagcactgacctcaaagccagcgaccgggttctactgttcctttctgcaagaacttagactatgagactcaatcccctcaaccgattaatgtaaaatcccctccatgccaatcttgcagaggataggggtggctgtactggtgatcttgctggggtaatggggtaatagtactggggtaatgacggcaggagtggtggttctattgctgctgacgttatgaacctgctttctcctccactttggctttagcaggactgaagtactccttggtgtgttcttatcaaacccttttttttccaggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattgtaagttccagatttgttcctcaagcactttgcaaagatgtcttctgtggctgaatgccagtcactctagatagaatatagccatcagatctttgcttcttcctagacttcaaaatgtgtgtgtggggtgtgtgtgtgtgtgtgtgtgtgtgtgcgtgcgcgcatgtaaattagcatattgtaatttttttctacacatcccccattcataagcagtcagaaaggtgtattagcatgggactgccattcagttagtggtctgctgggaagatcatcagcctgtggctttctagcatgtatgtacaagctaaaattttctttcttaaagcatcagaaagctttccaagtagctgagtcacacctcttataagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaactaaaaaattctcagtcatgttaccttagcgttttacaatgctacttacttaatctacctgttaaactattctctggtagagtaatttgatgaatgaacacagacttttttcatctattgtaaatttctttgctatccttcagcatgattttaatctttgtttaacacatgttgatgggaaaagtagtgttttttgtttgtttgttatgtaaacccacaaaacagtcatggtttgtccctcagtgcccagagatttcaacataaaagacaccttggtttctttaccaaggtattgggagtcatacttggctttacaaggttcacatttattgaagacgtttttggcctggttggtattttcctataacttggcagctctaacccattgtaaccttggggtctgtagcacagatctgaaagttcatcaagattaaggcttcgtaggattaaatatggctttgcatctgtcttaggttcaattttatttcgttttctttccaaaggtaacttaatacatgtaacatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatgtactgttgatctggaaggagcaattatgcataagcgaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagcttgaaatcatatagacagtattgggaaacagtgtaacagggtgggaagaacatgaatttgaatttcgttacgtcacttagtgcctcccctccttgggaaaattatttactctttctaagtatcagttgcctcatctatataatggggacgatggcagttattttccatgaagaagaaatgagacaatcctagtaaagcacactgggcctcttcaggaaaagtagtggaataaatgttattctgggattaactttaatgatgtttctgaaactgtttaatatttctgaatgtgggaaccttacatgtgcagtgaaattcactgggctttaggaaattattataacctttcagacatactcctcgcatttttacatgtttgcttgcttttctgagtgcgtaacaaaactggagaaggtctaatctgattaaataataggtttctacagtgtgtgggctcaagtttctatctccattccaggcatagtatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactatgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaattctctttaatcattttacatattttgttttctattttttatttattaacataatacaaatgttcatatagttttgcattgttagtattcatttttagatttttatctgtttagttttacatttagattacacacttcattttaaaaccatttgccagtcaaaatgtattgtgtgttttgcaatcttttagaattgtaaataacatgcctatagatagttaataaaaattttattttttattttgaattacatccttagcataaattctttgatttatattaccaaatcaaatttaatctggaggacttttgcattaccttgctagatttctttagaaatatttttctaatttacagaaccatcaacaataatgaaactatatgttaaaatgcaaactatcccctatggcagaagtttatttatattttctgaactaatttaataagcacattatgtcttagttattttaagtttgtgtaattattagcaaaatcaatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataaggaataagcagttgtgatattttgtatacatgaaattatttactaatataagtgcttaatctgattaacagaatttttatcattgctttttttttcccctttagtataatgtgatacactatagaaaccctctaaatctggggcaatttcttggctgtagttgctatggaaatactgaaataaataaatgtcatggaaggaatataaggacacatattaaaagcggaggttcatgctttgcttaagaagatttttatgttggtatgaatatgaagggcagcaacagtgcctcctgcttatgtacccttctgcacataaagagacagccttactcataagtatagttttagaaaaagaattgctgttttattcctagcattaccaaggagtctgggcctagggacagagtgcatcagaaattctcagcaaaagtctatttatgaagtggcagccaaggatcctcccccaaaccagtgcttttattcccagtggatggactccaggtcctaactctctgacagcagaaggtggtacagacatttttactagagttgaaatccaaatgactaaagggcctctggaaataggaggccaactccacaggaggctaaacactttaaggtacctgaaacttggcgcattagtgaccaacacactagcagccttttgctcccttatgtcatcaaatggctacagttaaaacattctaacttgtcagcctacattaagaggtagttttgtacctctgcaggaaagctgttcttttatatactcaattcttcttaataaaatgttttaaaagcacttatggccagtgctttatgtggatgttggaaaaggaagcaagagtttggactaaacctgaaaaatccacatgaactttcttcctttttttctaattgcctacgtctgctctctcacctccaaggagtgtttgtctgtgcctcttgtctctctttctgtctcacacaacacacacacacacacacacacacacacacacacacacacactttcttcttgctgttacatcatcatttcaccagaactctcctaggaaggagaaaaatggttcaagaaagagaaaaatttgtcaagcactctcttgggaagttaagcatgttacccactgggaatagttatctcttccattcatacagccccttacattttataatgctaccgagcatctgttgttgcatgctgtcatacctagtagagccttgtgaaatagatcatggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttttttttttttttttttttttttttggagacagggtctctctctgtcgcccaggctggagtgcagtggtatgatcttggctcactgcaatctccacctcccggattcaagcaattctcctgccttagcctcctgagtagctgggattacaggcgcccaccaccacgcccggctaatttttttattttttcatagagacggggtttaaccatgttggccaggctggtctcaaactcctgacctcaggttatccactgccttggcctcccaaagtgcttggattacaggcatgagccatcacacccagcccatgttaaattttctacgtgaagatcctaaaagcccccaactactcagatttaaaatcaggtataattatagccttttcccagaaaattttaattgataaccacctgactcatgctttccagtatcacagaacctgaaatgctaaacttctactgatgaaaaaccataagcccttgtattttcttgagcatttgaggccttaaaaagcaaaaaaaaaaggttaaaaatatttataacaactgacattgacattaacatttgctcagtgctttaacttttatgaagcacttttcttttatcatattaccctctaattaatgatcctagaaaatagttacagttatttttgccttcatttccagtggcaagaaactgaatcttagaaagtgtcagcttgcttagttccatagagtatgagtgtcagagctaatacttgaccctgggcctctgattcccaaggccggctatctctacatctaacagaaaacactggaaatcccatttgctgttgctaggttacctttttcccatgatggtaattcttttttaaaatcctaagtttttcattaatgtacgcccattagagaaaaattagcaaatagaagaagaaaggtatgtaattctctcatctcagtataatagttcacattttgtcatgcacttcttttctgttatgtttacctgtgggtatggaaggatgtatacaaatgtaaccacacatctgtatacatgtggttacatacacacacacacaatgagatcataccttaactattggttagtaccttgcttttgttacataacagtatatcaaactttgccttctatacagtccgttttaaatattcttgaaccactgaaaaagaatatatgtcacctacatatgctttctgaaggttgattcaaggatattttccaaaaggcaaataaagtaatcaaaataatatgcacaagagatgcatagcaaataaaatggtgaaaagcaatgaagtaataaaactactggtaaaaaaataaaggggcaaagatgtagtagtaaactcagaccaaaataagataatattaattacctactaactacaatattcatagaagaaaagtaccattcagtacaaaggtatcaagcagtctgaagaacattactttttgataaatgtcacagttccccatgaagaatagccctgagctttccttcattaaatatcattatattgaaatgtataatttaaaaatactgaagtaagagataagaagggtgaaaacatattctttataaaaccttaacacattgcttttagtctttgataaatcataaaaaggagttaaataatatgattgataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactgcatagcaatgagaacgggatggagccgacatagtatgccaagtaatactagtctcattaattgcaacaggaaacagtgcatatgtattaacttaaaaaactagaacagacaagaaaatcaaccttaaagaaatccattaaaataaaacattgttgataagttgaaaaatactgcaatgtttagatctggggatgattttttgaaaagagcagtgaaataaacatttggttaagataaccaagaaagaaacaaaaactacagaaaattaggaatgaaaaagacactcagcatagatacagatgacattttaaaattattgcacttaaaattttatatgagagactatgttctatgcaaatctaaagtacaggtgaaagaaacttgaataaactcgtaaagacagatggaatgtgaagctactacttgcaaaagagccagaaaatttcactaatcaaagttttcagatctccaaagaacaaatgatttctgtgctatttcaactttaagagcctagcaaaaaacgagatgcttaccaaatcattttataaagctagcgtgctcccaataataatacctaacctaggttacccccagaagacaattctgtgataatctaactttcataaatgcagaaatcctaagtgaaatattagcaaattgaataccacataataaaacattccagttattccatattcagtgctagaacaattaggaatcttttagcataatttgctatattgatatatcaaaattttagaaaaactagtaatctccatagatgcttttcattaaaagggcatttaataaaatttttcatgcattcatatttaaaaacaaaaacaatggcaatgcaaaataagctctaagtagtatttacatatttcgatttattatgcaacatttctaacatatataaagatatgaagcataatgacaaaggtccatgtacctgttatccaatttaagaaataaaacattaaaaattcagtagaaatcccttgggttctattccatgatcatgttcccccagagagagccactattctaaatttgttttttatcattttatgcatttctttaaacaatatgtagtgttgttagcacatagtgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaattttaggtttagaatatataacagaaaagtgtcctcatacagaagcaataaaaaatataaaatatctaggtaaaactttaaaacgtataaatgatctaagtgaggaatgctaaaaaagttttgcatgaataattaactcatgagcaaaaagggtattttggggattgaatgtgctttggaaagcctctctcactttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccctttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgagattagtaagattttggttggagagtgtagaaataggacagcgtttgctttcaccctaaccagaatgaagggtctcagatttccaggttaaatgcctctgaaactttattctagaaccttcccactgccctagtttgtttaagtcaagcatgaactcaccactcaatgtttgccagagtttggatgaatgtcagcatcaggctactgtaataatggtttaagattatttaatcccattagttatacacttcattaggctgagtgaattgttggcagtggttcagtaaacttcctcctttagagataaaaggacagaaagaaaataggaaaggagcctattcctcattttctttcatagttataattcttttttttttttttttttttttttttccgagacggggtcttgctctgtcacccaggctggagtgcagtggtgcaatctcggctcaccgcaagctccacctgccgggttcacgccattctcctgcctcagcctcccgagtagttgggactacaagcacccgccaccacgcccagctatttttttttttttttttttttgtatttttagtagagatgggtttcaccgtgttagccaggatggtcttgatctcctgacctcatgatccgcctgccttggcctcccaaagtgctgggattacaggggtgagccactgcactggccataattcttaatggataaaggaatgataattacccagctgtagcgtggactccatattagtacggtctcctaaactactcttcattctcaggagaaataaatgtttgtaacctaatattctctattagaagaaaatggacagtggcagagaagagagtgtgtgtccgtgtgatcaggccataaagttaatcttaaaagtaaacctgaaaataaattcaaagattctagatatgagagtcttttacgtagtggggttggtatgaggcagtaaatgattttaaggaaagaatatagaatttaaagtgagacctggttcacactcagccagctgctattctgcattcttccctttacttttagcttcagtttcctcacacttagaatgaaaacaaacaataagagcaaaccagtttgttatatgttctcacatctgactttgtaaaacagtttgaaaacattagcgtgctcagctccaggattgtcccatgcaggcaatgactgttacatctttcccttctttgtagtttatttttgcccagatggatctgcattcatttgtactatctattataatattgttagaattcactattatactgtagaattcattaattctattatattgtagaattcactaattctataatattgtacaattcacattatatattataacattgtagaattcaccaataatattgtaaaagtcactaataattcataaaaggaatgaattcatttgtgatcttatcaaaaaaaatttaaaaagaaaaaagaggccgggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaaaagaaagaaagaaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttatctcccatcagctctcctacacattctttttacaacacttgcccaaggtgaggactcttctcctggacattgatatggaggtttctctgtctattcccatgccattggttgcctaccttctgccttttccgatctccagccttaaaatgctttcctggaacttaaccaactagatgtaaccatttctgaacatgcaaggttttcatttccacatctctcataggattgatcctcaccacaactggtattatcaagtcactggcatccttgacacactccagtactgacaggaaccccttgaagactgtgcggggtgcggggaggtcacccttttttcttttcttttcttttcttttttttgagacagagtctcactctgtagcccaggctggagtgcagtggcgccatcttggctcactgcaacctctgcctcctgggttcgcgccattctcctgcctcggcctcccgagtagctgggactacaggtgcccgccaccaagcccagctaatttttgtatttttagtagagacggggtttcaccgtgttagccaggatgatctcgatctcctgactgcagggaggtcacctttaattcgtctttgtcttttctgtagtgcttatcataataggtgaacctattgctgctctgatagtgagggggatttggggggagcctgtgtcactctagcactatgtctccccacagtcattgactcacataccctttgcttgccccttcgtgcacctaggacctgagactatgtatgtataagaaggaaggaggagaacttggctctgagagactatgaacagagtcattgctgaaatgtaaatatcaaagattgaagggaaagatgtgagagtgaagccagctgtctagcttccagccgtagaatgatcataagagctactacactcaaggtcaaacacactgactcacccatgaaaattgccaaggagtttgagtggaagttctctgatattccaatgactttgaatgggacacggtaattccttcccacagccagggcttacttaaaataagtaaatgaataaataaagtctactccctggatcttttttttgctcttgtccctgcagagtaaggggatgccagccaaggctgacatcatcattatagcaagacaggtgctttttttgaatacttcacaaggacaagggcctggtattatgtaggtcttcaaagaatatatatatatataaatttttttaattcagtctcctacatttatagtatggggaaataagacaagagcgaggaatgccttgcttgggatattgcaattggatggctgcactgaggactatttaagcaaccttaaaatcacaaacacacatctgtgatgactttttaattatatctgtcattttggaaaagatattaaacatcttcctcagaagttatttttactttacacactctttaataatgttaaaagatatttgatgcaatttatattaataaagctcatgggacgtgttagtaaaaataaaattgaatcttctaaaatatattcctttaaaaatgaatgtctataattttatgctagtttaagcaaataatctgaataaatcctgtttgtttagcataacacatgtacacgtagtttctccacaaaatggaacgcgctaaatgtgttggggcctcaggaaagaactagtggaagggggcataggaggatttgggggcaaaaggaggaatccaaaaagaaggtcttcatggaggaagagacctgtcccaatgtgtcattcggtagatctcactttctcctagtacctcatagtcattcatttttcacccccaacagacaagtggagactgatattattcccttttacaatgtaacaaaatcaaagcttagaaaaccagggggtttggaaaataaggaatttgtgtaggattaaaatagaactttgagctcctggactctgaatcttagcttctaccttgcacttaaataaatttatgctaacagatgtcctgtcatcagataggacttttttttttctttttaatgtcggcaagtctcattgttacagctctctggtctgcccagtttggttacacctgttttgagattccttgcctatacccttccaactgaagacaagcacttcctactgtacttacagaactttcatctatgtcttggtttaatcttttgcctttgttttaaccgtttaccacttctgctttatattggtaggtaatcttacccccaaatacatagactatgagctccttaggagcaaactcattttttttttcctgttgttctttgtgtctttttttccctatccacctccaaatcttactccacatttctgaaaatagcacccaaagcaatacctctcactttggggagtatttagtacattttttaaaaaatgaatgtattatacagtctggatcaccataacaaaaatacaaggactgagtgccttaaataacagagatttattttcttatagattgagaatggaagtccgagatcagggtgttagcactgtaggattctgctgaggactgtcttcctgacttgtagatagccaccctctcactgtgtccttacatggtgtgtgtggggagggagcaagcccactaagtgtcttttcttataaggtcactagtaccatcatgagggctccatccttatgacctcatctaggcttaatcacttctcaaaggccccatatacacatactatcactttggggttaaggcttcaacatataaatttataaagggactcaatttagtccatagcaataaattaggccttttgactatagatctgtaagtgcataattggcactgattgatggattgcagatcagaatatcctatgcttctagttatatagaaactacatgcttagtgttttttttttttttttagacagagtctcactctgttgcccaggctgaagtgtagtggcacaatcttggctcactgcagcctccacctcccagattcaagcgattctcctgcctcagccttctcagtagctgggactgcaggcatgtgccaccacgcccagctaatttttgtatttttagtacagacggggtttcaccatgttggcccggatggtctggatctcctgacctcgtgatccacctgcttcagcctcccaaggtgctgggattacaggtgtgagccaccacacccggcccatgcttagttatttaacagaggtttattgagcactgtgttggctttaaacaattttgctagacattcagtagggcctgatgagtgtttaagacctcgtacagttcaggtgcattttcctttaaggatacatttaacctgctagatgtcatctcattttgaagacaagagaaaaagagaggaagacttgttttttcagagggttattatacattcctattagatcattaggaaattggcacaagtggcaggaagccaaactgacctgagtctggctgggcagtgtctgcaggttactccagcaaagctgctggaataacgatgtgttcttccataaagtgctttttgtcaaagtctcttctggaattaactcctcatgcacagatcgataaaccccaccaacttgccaatgtaattaagaagtgacaggttaagcataaccattaattaagttcaaagtaaaagaaaatgaagaagattgtttttgtgaaattgtgctgtcagatttttctcaagggtatttctgagttcctataaaggggaatttaggaaagggaggagaagattgtctccacttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacagtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaagtatcaaatagtcttagactcattgtcttcctctgatggcatcttaatggaattcaatacaaaggccaaaattcctttgttttgaagccacaagaaaacacagccaatggaaaagccgtgttagtgctgcctgtcctattctgataaggtgaatacttaaaagctatgaaagaagcactgagtactgctggacagtttgagttcatttggctggtagaattgagtggaagtcaattctcatgccatttaaactggaagaaactgaagattctccaacccaagctcctctttttgcagatagtcaactgaagccctgtaagactgtagttttatagataaaaaagagccatgtgaatttcctaaatcacataacagtcagtttattatttgacatttatggtacattcacatggaagagaatgattagacatttccaggagagaataacgactcccaattccctgagttaccattagatggtattaagcaacttcacttaattatgtacctgttttccagttatgttaattatacatcctttagcatttaccacctgtaccaatcatttagcataataataccttatacttaaatgcaagtacccagaatacttttatagttgttttcatttgatattcacaacaatcctacaaggcaagtgttatttctagattagatatgagagaactgaggcatagagaaggtaacccatatagccaagaaactaaaacagggttctgacatccattttctaactatgcatctaggtttttttttttttttacctctgcgtctaagttgcctgcctaaatcgccttcagtccattgaaatccatccaatcaatatttactgaacatcatctgtatttcaaatattgtagtgggcattgggggtatgaaattgcaaaagagagaatcatcagtatttgggaaactcactgtttgaatgagatagaaagccaaacagataaatgggaattattttaagtgccataatgggtctatgcactgtctttggagattggatggacagggtagcaaaagattgaggagctaattttgctgctgtttatctaagcatgtcagggtcctgtcttttcacgtagattatgagtgtcttggcatgtcttttgtctctctgcatcccccgaggctccttgcacagtcctcacactccactggcgttctgttaatatttgttgatgatgatactggtgattttttctctctgacatccagaacactggagagattttctgttggcccttgggtataacagatttttatttatacatttgaattagccttttagaaatcattcttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgttaacacatcaaaatagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaccctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgccactaaattatttttttgaaaaataatacagaaatttgtaagcagacacaacagctctagtttatccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgctgtcagcatggtatttcaaatgcttcacaatttgaatttaaactagtcaatgggatcattaagattattatgcatgttttccaaagagtttgaattcaaatgacaacttaaaagaaaaaaaaaaagatgtccttgaaaaactaaggaatgttagtgcacttatagaaattcttgcagtttggagtaatttgccacctccccttctgaaaaagtacctgatgatagtgtgcttgagagataggggtattgcagacatattccttaggtgagtaaaactgaattgtaaagtggatgctatggaccatggattatttcatttagtacgattgacagtagaaaatcaggaagggacgtgcatcagtgcgaggctgacacacagatctgaggatggcagaagctcactgaatagcacacgcaaggacccttcaaactcatcacatgtgccgtttggttccctttcaatgggtcggtcttggaatatggaggtctgctttcattttgtgccaagtaaccacgtgagcagtttacaaaagatacaaacagaaggctgctcattcatttttcaaaaagacttttttttttttgcaatggagtttgcaaagtgattttgcaatggattttgcaaaaaaaatggatgccattttttttaaataagtgtaattccaatgatgggaaatttactagctctcaaggcagcttttccttgtgttgaaatctctaaaggttaaaaagttactttttggaaagaagtctatttccttacaacatgttttcattggtccatagagaagacagctaatacatcttccacttggcagccttttaagtatttgaagaaaattctcaagtccatctgaatcttctgttttggctaacttctagttccttcatccatttccaacctaaatttgagcctaacgaacagatttcttctttcttatttaaatatatatatatatgaggaaataaaggcacagagggcttaagggagttgcccaagaacatagagctggttggatgactggaatgtaaggctgtgtggctctaaaccttgtcatttagactagaacacctatacgtcagttagcttcctgccacttcttgttttctgcctggataggactttataaagagtttggaagaagggagagttccgacgaggtacagaaatcagaacttccccttcttccaaactatatacaaataatcagttaatcagattaaaggactcttagtaacattgaaatcaaacctttgtgtttccaggagctctgagaacaacaatttttttggagcattgcaatctcttgagtatccaaaatgattctgtaatgatgtctgtgaggtcagaattggagcagcaaatggaattcctttaagggcttcccatcaatggacagctgattccagaaatggaggaggcacagtttgtatccaaattcataagcacaagtgggagaaattaggctttggtaaagagggtgacattcccaaaggaatcatctgtgaagttggggaaggaattcaagctcagggctgctgttctctaccaggttcttcagccagctggacatgctccccaggtttctactcagtctggaatgttagtaaaagtccacttcctctccttgtttctcccttctagtgaaaacgttcctcttctctaccttcctgacctcaagaccattgttccacacatcccccctcaggatcccaccccgccattctcattctcattacattgtttctggatccatgtctttatcagatgcagcccactgtccctttcagaagatgccagaaaatttacatatgtgatcaaatgttcccatcacaacagttctttccagtaatcccagtgctgggcagctgattccagtaatggaggagacactttcagctattaggcaatggatcacactttcaaaggagattgagcaatctcctcatcaagttgtacttagagcacaaatctggtgccaaaaggcactaccggattcagactgacagcactgagagttttgagtgaaagggaagttagactggtgttatgtgtattcactgggaggaactcaccgggagaaataaagagggtttccagtttattcattgtgtaaagcggctataatagtatttataggggttttgtgaatgtcaaataaaattatatttggaacagtggctagtgccataagtaggacttaacctttagcaatatgtactacattaaaaggaaggtggacacatgagtgatctctagcattttgtgactggaaggaaagagactggatgaccactcttcagagatgctatggacagtacttttgtcaaggactgggagtggagaaaatgacttatagtggtctttccaacatgaagtttgtattaatccgttttcacactgtgaggaagaaatacctgatactgggcaattataaagaaaagaggtttaattggctcacagttccacacggctggggaggcgtcaggaaacttacaatcatggtggaaggcacctcttcacagggtggcaggagagagaatgagagacaagcaaaaaaggaaaagccctttataaaactatcaccccctgcctcggtgcggtcgctcacacctgtaatcccagcactttgggaggccgaggtgggtggatcacgaggtcaggagatcgagatcatcctggctaacacggtgaaaccccatctctactaaaaaaaaaaaaatacaaaaaaattagccggacatggtggcgggtgcctgtagtcccagctactcaggaggctgaggcaggagaatcacttgaacccgggaggcggacgttgcagtgagctgagatcatgccactgcactccagcctgggcgacagagcaagactccgtctcaaaaaaaaaaaaaaaaaatctatcaccccccttgattcacttacctcccactgtgtcccttctacttcacgtggggattatgggaactacaattcaagatgagatttgggtggggacacagccaaaccatatcacacatgaaacacagaaaaaggacatctttttacatggatcttctgatatgcttgtaccaaagcccacagtatatcctgtcttcttgaaagagtatcatagttattcatttgccttggatggaaataatgttgtaataccagttaatacttttttcaactaaagggaatttggcttcatctccagttgcaaattcacatcaggaaatatcaaatccaaagatcaaaactcagtatctcatcactttcaggaccatccttgccacttgtctcaggcatcatgtacctggaagctgaaaagcaatgtacagaacctttgaattggagagatatcaatttgaacccagatcctgctacttcctacattgtgaaagggatcaagtttctttagttctctaaagcaaaggtttttcatctataaaaggaggttaataaaagggaatacttatcatgttgaattaatgggaatattaaatgagtttatgtggtttaattgcctagcacagtatctgcctcctaagatatgtttaataaatgctaactgtgactatagagatttaccctgaagatacctgtcatgtcatgccttctctgtcaaatagatcatgaatgcagttcctagcctctctctcctgttataccctcctagcaatattctgatgcagatgaacccagccacttgtcttttgcttgccagaacagctgaatgttgctgggaaaaaaaaaaacaaaacacagccgggcataatcatatcattataagttgtgaccagccttgacctgcgccttgaccccacccacagcctacattcttacaccctgctctcaactgtttcagacattctctactgtgacttctatctcccttccccactccttccttctcaagggatgccctggcctcattcttcatagtgaaaatgaaagctgccagaagaaactctttcagcttctgctctcaaatctgtgcccatcctttctgtcccttagtgcctatcagattatcagttgccaattggtctccatgtatctctggtccctttttcccctgtcttctgagtgccctggctccatggatcatccattctttatcctacccaatgggattcttctcgtcaacatccatttgtgccccagcttggcccatattttccctccattgactccacagctctctgtagctattgctttatcccttccttcacagccaaactctggaaagttggatattagaaatgctgtctccacactattcacaatagcaaagacatggaatcaacttaaatgcccatcagcgacagactggataaagaaaatgtggtacatataccccacagaatactaagcagccataaaaaagaatgagatcatgtattttgcaggaacatggatggagctagaggccattatccttagcaaagtaatgcaggaatagaaaaactaatgctgcttgttctcatttataagtgagagctgaatgatgagaacacgtggacacaaataaggaaacaacaagcactgggatctacttgagggtggagggggagaggagggagaggaatgaagatagctgttgggtactgggcttcatacctgagtggtgaaataatctgtacaacaaacccccatgacatgagtttgcctatgtgactaaaccttcacatatacccctgaacctaaaataaaagttttttttaaaaaaagaaaaaaaaatcctgcctccatttttctatcaagtattctgcctgctaccaggcccctatcccttcatagactagctgaggacatcagggacttccatgttgccaaaaccgtgagtctaatcagtgtttacctaacttgatatctcattcttacaaaactgtccctcccaacttccttggcaccccagcctcccgattttgtttttaatttttcaataggttattgggggcacaggtggtgtttggttacatgagtaagttcttagtggtgatttgtgagattttcgtgcacccatcacccaagcagtatatactgcaccatatttgtaatcttttatccctcgtcccccttccacgcttccccccaaatccccaaagtccgtcgtatcattcttatgcttttgcgtcctcgtggcttagctcccacatatcagtgagaaaatatgatatttggttttccattcctgagttacttcacttagaataataatttccaatttcatccaggtcactgtgaatgccattatttcattcatttttatggctgaatagtattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatattccatcatatatatatattccatcatatatatatattccatcatatatatatattccatcatatatatatattccatcatatatatattccatcatatatatatattccatcatatatatatattccatcatatatatatatttccatcatatatatattccatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattcatcatatatatatattccatcatatatatatatatatatattccatcatatatatatatacacacacacacacacacacacacacatacccacacatcccagtttctttatccacttgttgattgatgggcatttgggttggttccatgattttgcaattgcgaattgtgctgctataaacatgcttgtgcaagtatctttttcgtatgacttcttttcctctgggtagatacccagtagtgggattgctggattaaatggtggttctacttttagttcattaaggaatctccacattgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatattaaacatcagtgcaggctgggcccggtggctcatgcttgtaatcctagcactttgggaggctgaggcgggtggatcacttgaggtcaggagttcgaaaccagtgtggccaacatgctgaaaccctgtctctactaaaaatacaaaaaaaattacccgggcatggtggcgggtgcctataatcccaactacttgggaggctgaggcaggagcattgtttgaacctgggaggcagaggttgcagtgagccaagagcatgccactgcactccagcctgggcaacagcgtgagactccgtctcaaaaaaaaaaaaaaaaaaaaaaaaaaaaaccaaccatcagtgcagaagaggatgtggagtggagagactgcatcaattatattttgctgatgagaatataagatggaacaaccattctagagaaagttttgggaatttcttcttttaaaactaatcctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaaggctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgttgggggaaactggataaagggtacttagatctctacgttatttctttcaacttcatatgaatctacaattataagaaaatttaaagtttaatttatagaaaaggcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagcatttaaagatgttgactctatctttgtttcatttgacttctatagcaccgtacactctgggttttcttcctatcgctgtacacaactttctaccgtttttaatagatttcctctcttcattccttaaattctccatttttcttgagttctgccctaatctcccttcttgtctcaatctgtactcctgagttatttcatctgcttccgtgagtacaaatatcatctgtgtgctgagaactctctggccaaaatctgcagctggatctctctgtaagctccagatatgtatctatcattttagcctgcagtcttcatagattggcccataggcccacaaatgcaacagtttcagacagaacccaaggtgttcccttttaaacctgctcctctctgtgttccttttccatgaatggcattaccttgttgctccaaccaaaggcacaggagctggcctgtatccttcctcttccttcagtatcccctcttatccacttattaaccaatttctgacataatactttggcttcctttatatcttctttcatttatgagacaagttccttcagtgttttctagtgacttttcattacttggaagagacagttcatactcctcacactaccatgtaaagagctcatagccacatgcacacacatgcacatccacttgtgcacacatacctaaacacacacccaaaacagagagattgtctcatgcctgtggctgggtaaacacttgtccttgatggaatgtgtagctttcccatctccatcccaatcacctagccaaaaactctcctccttcaggcctccatttagacatcacttttccctcaagtatgtgtgattcttgtgccttatcctccccatcatcctgtaatagcatcctctgcttttcctcatcatagcatttagaagactgtatttaaattacctatttgacacatacctcagtagctatacattttccctaaggggagggttgatgtcttgtttctcattgcatcctgcagtaagcaccgagtaagtgtttcttgactctggggctgtactgagttgaagaaggatgacatcactgactacagaaccctttgtataagcatcaaaggggtagcagtggggtaaatgatcacatcctggctaaatggttccgattcctacaaccctgcagcacgcccccccggctctaaaccttttagtcatttcctgtgaatcttgccagcactcatttcattttttgttttttccattttcttcatctttcccacatagtatagaccagaatgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaaccctttttgttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtctctagttgttctgtatataaaagctaaacttcttcacatgtttctgtttctcttgtttatgcgatcgtttgtcattggccttgtgttggtgatgtatgttctgaatgaataggctccagcaattaagtgactgagatgaaatgcttttgtatctctctagcctcatttcttttttttttttaccactgtgatgcaaacacatggaactactgttctccattgcaccatgattagtctatccgtagtcttttgtgtgtgatctttctgtacctagaacactcgtcttgggcttttgcctggccagtacattgccatccttcaggtctcagctgatttttcacttcttccatggagccccctctgacttcacaagattgcgttgtcctgctcatatgtcctgctcagagcatgctgcatgtctcacttcatagcacctgttatttttttagtatagattttggttttgtttgcctgcaccccattccttgaggacagggaaagtttctgtccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacaacttaacgcccttcaagattttgtgtaacagggaaaggagagaacacctggaatggttcccgcttggagaaacgtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagcttctctgatgcagtgcagttcagtgcaaaccaacggaaagcccacagtttttttgtttttttggttttttttctaggtgtaaacaaacctggttgattgtgaggcaaagaaaaataacaaaaacaagtgagaatacattagattaatttactctttcttttttcccgctcattcataatgtgattgaaatcagaagtaaagaaagtaaaatcagagtgagttccctctgctcagtcacccaccctgatcacaagacttttggaatactgggaggcactgcatttaagtaagtatcagctgtatggagagtatgaggttaagatgatgctggatttaatttaaagtctcctcactggtttgcgtgaaggaagatttttatcaagcagagtgaaagagacagaatcttgaagcttccgcagaggggaagaagacagggccgtgcactgcgagtcagtatgcctccagtccctctggtgggcaccggtccacatcacaggaagcccagctgtggtggctgtcagtgtcagaggggctggcagacagtagtagaggcccagagaagttactttgtacgtatcagtctagaaggaagagattatgaagattagtcaagcctccctttctcatttatccttttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatgttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgggcaacttttctagccttccgtctaattgggtttaatatcagtgaaagaatctttaagaaggtgtgcccttaggtgctagggccagtattgtaggtggcaaccaggtacattagtctctgcccttgtggaactcatattcccatgtttgtaaaggagtctgggcctcttatatgtggtaaatgaagtgactgtctatgtagttgcctttgcaggacacaagtccttgccttagtttccctccagccaggactgccccaccgagactattcatagctccaacttaaggtgctttaataaagggcagaaatcatgacaagaaaggacgcttttcttcaggcaatgaattcagcctgattttagaagctgttttggagaggtctctgtaagcatattacattttattccctgcagtacaatatttatacatggataatttgtattgacagttgatagttacatagaggtatatctcactggttctcaactctagctgcattttagaatcaccaggagaattttctttttcgattctgatgcctaaatctctgccctagaacaataaaatcagaatctctaaaagtgaggcccagacatgggcagttttgttattatttatcattgtttaataataaatattacgtaaaagtcagacttttaatggctcatttgtagggaggagaacttgccatttcccaaagtatcaccagcataaaaggtgaatttgtattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcgaggagatttgagattcagcacaaaaaagaattcgatatcacctaatacaagctgagaagggctacctcagggggtccttgtgcacctcactaaggaaggtctttggcagaggcagagaccatgacaaaggttttttttttctttattggacaagagccagaaaaaaatggccccaagattatgctcagccccgggaacctacagaaaccatggagcagtaggaatgggtagctagccgtgttagaagtaaatttgaggccgggtgcggaggctcatgcctgtaatcccagcactttgggatgccaaggcaggaggatcacgaggtcaggagatcaagaccaacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcatgccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacacgtgattttcttaatgtcttagtttgagcaagtaattctaactactctagcaaacacatttttaaatctcagggatttaacacaatgcaagtttatttttgtctgacaaaaatcccccatgtttagccagtgcattccacgtgggattcagagactctgtcttattccatccagtggttccaccagtctctaaagcctagaggtcctatgccagattatgtgaattaaaattagaagagagtattaaggatcttctgggacagtggtgggatggttacagtttccagactcataaatgtaaaacagtgttccttctacaaatattctattggctggggctcattcactttcacacagtaacaaagaatgcttggaaatgtggccacactgtatacccccaaaagaagaggaattagtttggttcaaatttatctagtctctgtcatgctttcatcatcatcatcatcatcgtcatcatcatcgtcatcagctactgtggatcagcatactttcctgcaattttccaaatcgaattttgtggttatatattaacagagtatataaaattcattttccctacataatatgtattttattcctatatgtgttttctgcagtggtctgatttatatcaatgactaacatatagattcgatttgcaccaactagataatttaatctcttactcctccttgttgacagttggtggggtgcgccttatttttgaagaagaaaatgcttatccagttattcagccaatctcagttgacagcctatcacatgtcaggcactggaaattccgtggtgagcaaaaacagacaagtggcctgctttcaggaagtttctattctgttaagggagatggacagagtgttttaaaagaaaggagtattgtcctaagataattaaaacacaggaacctgacttagacagagattaagacaggcattcctaaggaagtgatacttcactgagttatgaggagtgagtaggagtttagacatctccagacagtgcagcacgctgatttgaggaactgaaagaaggccagtgtggtcagagctcagagactgagggagaagcatgatgcaggatgagttttgagagataaaccatgaaggacttaggccttgctaagcattttggcctttttcccaaaagtacaggaaagcctagccattttattattttataccacccatccattacaggcttttcctgaaaggtctttggcaataggggagctatggaagcaacatcatgagtaagtgactgggggaaccttttccctaagtgttgtggttgctagccacacaccatgtattcaacatctctccaactctcctcatcgtttcccagagctgaaagtaagatgagcacgaagaaaccatgtttagttaagaacatgacccgaagagtgaaaggtatttcctgttccaaataggagcccagtctgcattttctactacatgatttagtagaaagacacattggatttgaaccatatttcttctgctagccaattccatcttatctacaactttttgataattattttgagaaatagatctagatcacagccttccaattcctaggccaggatactttccatttttctacacagaccccattgcagtcctcccttcttcacaatcttcaaaatatccttctgattgaaccagatatcttattcttcatcccgtttcctgccccctaaaatgacctatctttcccttctaaaacttccactaactttaaaattggagctcaaggcttccatctccacagactctgccctgacaacaaattggttggttttattttcttcccaatgaatagaatagccgttagagggaattgtcttcagctcttttcccctcctcctcctcctcctcctcctcttcctcttcctccttcttgcaaatacaaacacagcagggctctatgcagctggttactctaggctctggtaacctaacatagcaggggaggacagaagtcaatagcgtgagaagtctgtttttgtcacggatttgctagaagctattaaagtgttcttcctaagtctgttacttcataggttgagggaagtaatgcatcccacacaagaggactgggatatgtttaaagtagtaggaaggcatttgccactattctagtccatcctgcccatgctgcctaatgtttgttcctacagatcaaaatctcataatcttctagacttctagatacagaagagttggagagatcaaagccttgcctctgacccagattattcgatctcatctggcatatcctacactctagccatcctgacctgccgtgtgttcccctaaagctcccatccttttctgactttgcttttcctcattctgtcccctgcattgaaatgcctttcccacatctctatgtctaaatcttacatggccaattccaacgtaatctaatctctgaagattccctttgctccccagttagaagtagtcactccctgctctgctcactttttgacatatattaatttatatagctatgcatttatatgtgtatgtattatattccttacaagagaagcttttgagagaagggcctataacttttctttctatttgtgtttcccaaagctccttctggtgggaaaaatgctttgaggttgaattaagctcacattgaactctatgatgaaaccatttgcttatgaacttggacaagtttctttacaactctgaaccttctgaattttccaccaggagaatgggaatgaataagtaagaaaacttataagacagctcctggtgtagggcctgactcatgtcaggttcccaggaaggccactttatatccttcatacatttgtatgtctgtgttgacattgaatgtttgcatgacatataaaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacataatagacaatgccactcataaatctagcccactctaggaacataataaggcctgttgagacattcagagatgtctccctgatcttcaaagatgaatttttattcttccctaagctgctgtctcttcagtctcaacatcctaagttcattttatctttcctcacaggtcaggttttcagctctaactgtgttcatcctggtggctctgccctggacatactgcagttcttttatgtacctcttatcgtatggggtacaatggctttcggtactgctcagtgaggggagagaaatagatagtgtagtttctgatgtcaaggaacactttagagagaccttaattaatgtagccatatgttgacttcctggagcactcataacaacatgggaagcccacgctgggaagatgctgagtaggaataagagaacaatgctaagagaagggaaatttcaccgtctgtgaagcgtctgtttagattttatgtttaaactttatgaactctgtcacttgctggtgaattttcttgctcagtatcttaaaatacagctgcagtgtgggttccaccctcttcacttaaaagggtgattaactgtttgtgatgaataattatttaattgccagttcagctacatgtgtgtagttgttttgcttctttcctcttcagtgtgagccaaatcttctcaataataaaaataatccagaattagtcaactgccttttatcatgttctcattcagcctgctggagcaagaacattccaattctacatcacctttagcttaaaaagtaaataaatagaagctctcactcagccagttgatagttttactctcacagcctctcctgtaactaataaagtcttgacttcatcttgaaccttttactctatctttggataaaaatttaatcagaaagaattattgctcttttaatacctgtttaacctttacattcgcgatgggtacaaaaccacttaagatttaaagctctcttgttatggacttgtatgctgacctacttttcctcagagatattttttgcaagaattgttgaagcttgacatggggatcactgcaaatgtctcagctttgccattcactgctttccattcctatgtcctccttgccctgttaattattttaacagagacttgctattttaaggaagctctttatcgttactaaatctttttttattgttaaactcctttttctttccagcatagaagtatgtcatgttttctgtcttcagaatgtgcaagtgcttaccttctcataaagtgtgcctgttaccttaattttatagtctttatcacaaaaaggtacgtaagtggggttcagaatagtgtcttgcacttaaggtttaacttaggttttagtttcttcatgcaagcaacttgcatatgtagagaggcagcatgctatatagtgcaatgttcttcttggtttttaattataaaagtgatttcttttctagtaaaaaatcaagttatgcacaaatatatagagtgaaagtgttttcaactcctctctctagaggaagccactagcagttggcatatttccttccagaatttgttgtgtattataaacctatatacgtgcgtatgtatacacacacagtagtacacacattgttctgcaccttgcttctttgttttccctaagaatgtatgcttgatatatttctaaaaataataatgtatatgggtctaagtatttttagtgatatagaattctataggatacatgaaccgtaactcccttagtcatttctctactgattagtatttaacattgtttcttttttttttttttttgccattaaaagcaaatatctttgtgcaattatcttcatgaaatgttgaagctttctttttttttttttttttgagatggagtctcgctctgtcgctcaggctggggtgcagtggcgcgatctcagctcactgcaagctccacctcccaggttcacgccattctcctgcctcagcctcccgagtagctgggactacaggtgtctgccaccacgcccggctaattttttgtatttttagtagaggtggggtttcatcgtgttagccaggatggtctccatctcctgacctcgtgatccgcccaccttggcctcccaaagtgctgggattacaggcgtgagccaccacacccggccaaaactttctgcaggatatatttttaaaatgggttttccaagtcaaaagtgtatgtatgtttccattttgatacctactgaaatagctctccaaaagtgaaaccaaatttattcttttcaatggtatgtaagaatgcctgattccccatactctcattaaccttgagcatgttccatcttttaaatttttgccaagaagattgtctaaaaatggaatctcattgtttgtatttgcatttttatgatttttggtggatttagcatcattttctatgcttagtaactgcttgcctattcatatcctttatccaggttttttgttttgttttgtttctttttggtttggttattcatgttttccttattagtgtattggtagttatatgagttttaaccctttgtcagtggctaatttggaactcctccacagatccctgggggtttcttagagcagctgactggctggcagagctctccatggccttacctccccttcctcttctccgaactcacacacacactgatcgaacagaatagaccaattattacctgcatttcatgttgggctttgtgcttgagattaaacaaaggttcccggggctaaacgtctaaaaaacattgccatggaatgaagagccctagattttgtcataaagtcatctgtcctaggctctacaatgtagcattttcaaattggaagagccttcagagattattttattaccaacacccatgtaatataaattatacagttaatatatgttgatatacatgcaatactgaagaaatctctaatgcattctatattctgtaacagtaatatgtattttattatttataatagcttcaacatatattgaaaactagaggcacatacgtctataaacagtgctcagggcgtattattttggtgtttatttatttattaggtatttattattttatttagtccatagatgatgcatttatctgagaactcctctgactcaaggcccagcaagaatctgctgcccacagttatgagtagctgaactgggccaagcttttaattctataaatagcgaatctatgtagacactcagctagttagtaccagagtggtacccagatccgtgatgtcttgactcttagtacagtgcacttttccccactttgccattctttgctggtgaccttgggtagatcttcttaactgctcagagcttcagttcttctctcttttaatgagagtaataatgcatgcattgatatcctgactaggatggagttggataaagactgttcttaccttttgtgaatagcatagtatcttacagaattgtgaggaattatccaagtagctattgcccctcatcatggtgttaaaagtaggattgctagtttgaacggtaactgcaggaattcaatgtgttttgattttagcatattcccgtatcatgtagaccagtgttaatatttttagtattttatcttagttcttttttttctgaaagtcttgatttttcccagttttattttttagatttgaaagaaaaagaaaaaggatgtaactatgactcttatgttttcaatctctctgaaatataacaaagtaataactctaaatggtcaacgtagtagtctgagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacatccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccaacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatttaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaattgttgaatgtaggtgtaaatctagggagaaattacatcttaacaataattatgtcttccagttcatgaatatacatgtctgtatttatttagattgttaatttctttaattattgttttatatttttcagcgtaggaatattgtacatatttcctaaggtttataatgaagtattccatgttttggggtgcttttacaaatggtgatttaaaaatatgcaatttcaagtattcattgctactgtatagataagattgatctttgtatattgcccatgtgtgctgtaactttgctaaaattatttattctagtagctttttttttattcggggggaggtttaatgaaaaaaattatgttttcaatgtagtgcatctttatatatatatatatatatatatatatatatatatatataaaatggaatacaattcagccataaaaaagaatggaatcatgtcttttgcagcaacatggatagaactaggggtcgttatcctaaatgaaataaattagaaatagaaagccaaatactgcatgtggtcacttataaattggagctaaacaatggaaacatatggacatacagaatgaaataaaggtgggaggatgatgagggttgaaaaaatacctattggatacagtccagtactcactcttcggtttatgggtgcactaaaagcccaaatttcaccactacacaatatatgcatgtgagaaatctgcacttgtacccccaaatatataaacattttaaaagatttaaattacattttctgtgagtagaaacagtttcatttcattatttgaagtcatgccttttctgtttcttgcccaattgccctggctagggactttcagttagttgttgaatggaagtggtgaacatgaacatttttgcgctgttcccaatattaagagaaaacattgagtcttttgccattaagtgtaatgttagaagtaaggttattgaacatgctctttattaagctgagcaagtttccttcttttcattagttttctgggaggtttaatcatgaaagtgtgttgaattttgtcaattgcctttagacataagttggtatgataataagacttttgttctacagctggttcatatggtaggtaacactggttaatttttaaatgttgtatcagccttgcattcccaagataaaccccacttggttgtgttgtactactccttttgtgtgttattggatttaatttgccagtagtttgttgaggatttttgcatttgtgtcatgaggtatactaaactgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgcttaagttgcattctacaaattttgatatattgtgttttcattttcattcaagatattttctaatgtatctagtaatttttttgacgcatggtttatttagaaatgtgttatttaatttttaaatatttggatattttttctaggcctttctgttattgtcttttagtttatttccttgtgatctgtgaacatgttttgtgtaacttaaattcatctaaatttgttgaggtttgttttatgtgctagaaatatggtatatcttggttaatgctctgcacatttcaaaaatatgtgtattctgctattattaggtgaagtgttctatagttgtcaattaggttaatttggctaacagtattgtacaagttctctctattcttactgattttctgtcttctttttcagtaaattattagagggatactgaaactttgagcataattgtaggtttgtctatttctcctttcacttgtatggtttttgttttaatgtattttgaagccatactgttaagtgcacatacattaggattgttatatcatcttaaccccatattcaattccttccttattacataatatgattctttaactctgaaaatattcttgttctgaattttagataatattaatttaactttcttttattagtttacaaagtatttttccagccttttgtttttagtctatcaatgtctatataattgaagtagcttgcttttagacagatacgtctttcattttatccaatttgaccatctgtattttaatttgtgtgtttacactatttacatttgatgtgattattgatatagttggattgaaattcacaatcagcttttgttacttttccatctgctatatttttctcttcctgcctttctttgaattaaatgtttttcacaattccatctcatttacactatttgtttattatttatactcttgattttaatgttagtattaccctttgatttgcaatatacacctttaattaactagagtttaccttcaaatactattatatcactgtctgagtagtttcaggaccttacaattgttactctcaatttacttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattggttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaagatagccaatatctcttcaatttttattttgttttggtggtttgttgccttcattcttttatattttctctttggagttctaactacatacaggcttaatatttttctataattctttgatgctctgttctcttacttttcactctttctataaatttctattgacctatctttaagtttactaattctttccccagttgagtctgcttatgagcctattcaaagtattcttcttctctgttactatgattttcatttctagcattttcattttattttcataagacagaatgagaaatattctcatatgacagtctctatatctttgagatcatgcaaattttcttcctttttcactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagtgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatatattgtttcttgactttttaataatcgccattctgactgtcatgagatggcatctcattgtgattttgatttgcatttatctaatgatcagtgtcattgagctttttttcatgtttgttgactacataaatgtcttcttttgagaagtgtctgttcatatcctttgcccactttttgataaagttgtttggttttttcttataaatttgttaagttcctctagattctggatgttagacgtttgtcagatggatagattgcaaaaattttctccctttctgtaggttgcctgttcactctgatgatagtttattttgctgtggagaagctctttagtttaattagatctcatttgtcaatgttagcttttgttgcagttgcttttggcattttcctcatgaaatctttgcccatgcctatgtcctgaatggtattgtgtaagttttcttctagggcttttatggttttgggttttatatttaagtatttaatccatcttgaattaatttttgtgtaagatgtgaggaaggggtccagtttcagttttctgcatatggctagccagttttcccagcaccatttattaaataaggaaccctttccccattgcttgtttttgtcaggtttgttgaagatcagatggttgtagatgtgtggtgtaaattctgaggtctctgctctgttccattggtctatcagtactcttattctgcctcaggtctttcgtgtgagcatctgctgagatctgaggaaaagagtataaattaaattccgcttctatctgcactgcccaaagattctgtgttttaatactaccctacaactagtctcttgcaactggttaataactgtagttttttttttctgttaccaatagtatggcattcagaggccttaaggcagtaaggcatctgccttagtgttctgcaagtgttcacatcctgtctctcctcagaggcatctatctttccttagatttcaggttacagtagtttccccaactcccacttatcagtagttttgccttctgcagtctcagttacccatggtcaaccacagtccaaaaataggtgactacattacaatagtcatgtagagactattgtctctctacaaagagagagaaagagagagagagagagagggagaccacatacatgtaacttttattacaggatattgctataattgttctacgttattattagttattgctattaatcttttttgtgtctaatttataaattatactttatcataagtatgtatgtataggaaaaaacagtatgtataggggttaggttgtatccacagtttcagtatctactggtggtcttggaaggtatcttccacggataaaaggacactacggtagttggttgttctgcagcctcagttctctatggattcaaaaccagttttagatttgcacactgtctggcttgttttaaattattgtatgggtgggagtggtgctcctttcattttctccatcttgtacagaagccataattattttcaattctatataatttttgattgaatgaaaaataccataatttttttgttctattagtagacatttgaattatttatggttaggttcatgacaacaaggaatgcttctatgagcacatgtcttttggtgtacatatataaaatatttctcaagggtatagatgtaggaatggaattcattaattgtaggagaatacatacgacacacacacatgtatgagttatagggtatatatatatgtgcatataatgatttcagtaaattattgatataaaaattttcaatgaagtataactcatagaaaagtgtacctatcttaagtggccataggatatcatttagactgtaacataagagaactatagatattcacatccccaagcattaactgagaacctgttatacagtgggcatttaggaaatgaaaagtgaaggaaaagttactgaccttaggggtcttgaaagcgagaaaatgattaagtgctgtatacacacacacacacacacacacacacacacacacgcacacacgctcaaagagtagggagagaaaaattatgattggggaaatcaataaaagcatattggagaagacatcatttgatattaacctttaagtatagcagtgtagatagtgcgtaagaattggattatagaacttagtcattatgttaggaaagaaacctatggccttgttttatagcaattactggggatatccaggtcttttgcactggaagaaataatcttagaaccatttattaaggacagacccttacagatcatggggtccaaaactgtcttggggtcgaaaactttctcatcttatagatgaggaaactgaggcttagggaagggaagggacttgcctggggtaaatttttgctagtaaatgtacttaatgagatctctcagttacactgaaacgtttgagtattggaacattgtgcttttgttgttttctttttctttaaatccttaaaaaagttgtggatacatagtagatgtatatatttatggggtacataagatgttttgatatagacatgcaatgcataataatcacatcacggagaatggggtatccatctcccttcaagcatttgtcctttgtgttgcagatcattagaatattgtcttcatcattcttttattccccaccaaagtttttgtaaggtagtaagaggatctttgtggaaagaattcttattcccttacgttcctcctggtctgttcctaggtcaaggttgagtacgtttatagatattctataaatatattttattttcaacattaagtgtagttcatatagttgatgatctaagcaataagaaataaagtaaaatctggataattttggttactctgcttttcctctgtgtgtttcaactacaaaattcctcactacaatgctccccaattccttttattggtgcttgcagtgccagtgggcaaactgaattcttcatgcaaccaaagaattccaaaaacgtatttcttgcagctagcataaatctccagttccacaatggtagcagtggtggattttacccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaaggactaaccctagaatgacatttttccctcattcctgggtaatttttgagatttcccctcatgcccaggagctaattatactctctcactctccctctctctctctctctctctcgctgcagctttctgtatgtgtgtgtgtgtattatatctaagaaattttactccaaacatctaacattctgggtacgggtttgatttggggaaaaaattacacttttttttttatcctttagcttttctccttaaaaagtatcagtgagggcagggaaagggaaggagaatggacccaaactaataaaaggattgatcagtgattatgaacaaaatatagcttctgtatttccactcactcagtatgaagtttgctattattttccccaattcctggagccagttattgcagcaaatttagcatttggagcttatagactcatgctagacagacacatatagaatttacgaatcgaattagaaaaatggtctttgaataatataaattgtactccatgtatatttttatatatgaatgaacctactggactccagtgagattagcaaataccttagctatttcattgcaataaaaaccatttttcagtcactcatgtccctctgggttcttcagtgatattatttgatgtatgctttattctgtgccatttattgtactgagtattttgcatgaatgatcttatgtaatcatcagtaatctgttaaatcagtatcattattattcttgtttcattgatattgaaatataaaagtaggttatcataaattaaaaggctacgggtagtgataaaattttattccaggtagtatctccagaatatgaattcttaatcactactcgtgtttattcattccacatgtcactgaatgcctactatgtctagcaaagttctagattctcttgtagttgcattactcagttattggctagataaccctaaacactgcagaaagctgcactctgcccccttgggattgcctggctccataagattattaccgttgctgagtttggggacccacttgagcaaatctagcatacttaaaaggaagtttttattctggagaagttttgttaacaaaacatctattggctgggcagagtggctcataactgtaatctcagcacttcgggatgccaaagtgggcaaatcacctgaggtcagaagtttgagaccagcctggccaacatggtgaaaccctgtctctactaaaaacacaaaaaaattaggtaggtatggtggtgcacgcctgtaatcccagctattcaggaggctgaggcaggacaatcacttgaaccggggagacagaggttgcagtgagccgagattgtgccactgccctccagcctgggcaacaaagtgagactctatctcaaaacacaaacatacacacatacatacagacccacacacacatacagacacacacacacacgtctatttagcatctgtcccaggcagtgcttctcaatagcatgttaatagatgctaaaggacctttagttaggaggtcaactggtctacctctgtcacttagtagacaagaaggttgccctaaaatatacactaagacagtatgcattacaaaaaagccacaataaggacatagcttaggagaaatgttatgatctctcttcaccagtctccttatatgacactggttcaattcagaagtagaggtgaagatagttaatatcctaggaataaatgttaaatctcccttcccctttcctcacagtattatagtcaattctcataaggaaatggccctaagttacaacattaagcttttctattcacttctaataactgaaattccgcccaactgcctcctcacttgaattccatgtactttttttccaaataaattaaatgactttctctaagtcaaatgctattaaaattcttgttgttcctcaaactctgctttcttgtagtatcaggtttattgtgacttgaatgagacttatttgtaaatggatgtattttccattccatcttgctcttgcatacacacacatacactgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataattagactttctggattttagatctattctcaagtatatattgtatagagaaccaagatgttcaaggactgtagagccagttataggtttggttttaaagcacttcatcttagactcatttcctttctggctgatgttagttaaaataatataagcctgggcttaagattgtatctctgagtgagacaaaataatagatgattctatctccctttagaaaaaaaagaaaaaaaaaaagcagcagcagcagtaattgactcttacgcttaggcaagaactccacaatggatttgttggggaaaaaaaaaatgttttcctgcttgtatgtgttggtttagattttctgttgtatgtgtgttgtgaaagaagactttggataattattgcgattttccaagcagctggtcttccaatggcattgttacagggtcagtctattttcctttaatctgaccataatgtcatagaacactggctgtttctttggcaactgttcagggaagactagctgttttctctacctcaagccaatggtggactgcaggcaggttctcctgcaagccacagggaagcagttttcattactggggtctttgtatcaacaaatcacttatttcactgtgattctgttgagacaggatccgaaagtaaatttcataagaaaaaaatgattatacatcaagctcaggtgactttaaaatttttcctttacattgagtaaagtttctggccacttttgaccttttttttcaaatgacattattgatatgaaatcagaaactataactgataaactacaaactgctgtatagacacttttctacacaatggtcattgcttttattctttatctaagcctgaattgtaaggcttccttctctttttttttttttttttttttgagatggagtctcgctctgtcgcccaggctggagtgcggtggcacgatcttggctcactccaagctccacctcccgggttcacaccattctcatgcctcagcctcccgagtagctgggactacaggcgcccaccaccatgcccggctaattttttatatttttagtagagacggagtttcaccatgttagccaggatggtcttgatctcctgacctggtgatccacctgccttggcctcccaaagtgctgggattacaggcgtgagccaccatgcccggcctgaatgattccttctcatcttctgggaggtttttctgacttgctttctcaattccactctcttaggcagagcttatacctcccttcatgtatgttacatgtacatgtattgagtcagtgcatcctcctaatgaaacttttcctgagatctctcttatttactttcttccttttctgaaattctctgctatttagattcagtgccaaagaaattgacatttttatttacttgctgaggaataaacagaactcgaaaggatttgggaacccaagaccaagttttatgaaataactaatcttgtcttcctaaatactataaaaatcttatataatccctaatacttagcatagtgctaagcaccgaataggaatacaagaaatattgcaatgatctgaattgcttacaaaatattgacaacaacttcttcattggtaaagaaaagctgcttttgacctttttttcttcctcaagagtaagtagtgagaagcataaagtacccaagagtttctttgcctttttgattgttgcatggaaacaagtatttgcaaataattaagatgggaaaatttggctccttgaaaaggcaggactgctttcagatatatttgaaatgaacttatacagaagccaacatggttatcagagcaattgggtctatttcctatcatctcttcatgatatcttgtaaaaatgccctgtgttgagagcactggtgatcatagcagtggggttggagtagaatctggtgcgtttcttcctctacagatctcctaatagcacttgccctgttttcacagagccttatcaaagtttgatgtagactccagtgtgtagtagtgggcagtgacctaccagatgacctctttgaacaagagctagtttgagccagtgtatagctctgaatcgatggaagatccattttcaaatttcaaaagggctgttaaaacacttagttctgtattatagagatacacaaatggatataacaaactggatgtctcttctgcagctgtttcaattcgtatgccatgttttctatccttcttgctcctggcaattttctttcctgaagcatatcacaccttcttacatttgacaagcattttcacagctactgccactccctgctgccaaacaaaacccagccctgtttgaattcttgagggctgagggatggagaggagacctgtttgactttgaaatggttttaacgtcactttgtatacagaacaaaaatggaaaaccagatcctgtgtttgtctaaaaactaaaatttcaaaacctaacctgaggtggagaaacagatactacagggcaaggaaatgtctgggctcaccgcaaaggaatgcagcaagggaaccacctgcagacacctgtttaagagtttacgtttttgttcttccacacgattattatcttagtatctcaactggctatacatgcttttaggaaagttgcagggatcatattctaaggcgtatcaaatatgttcagagtgcaagcatgagcagaatctctcctctctgctagtgaggtcctgtaggtctacaagttactaacttcaggcttacagaatgttagaagtaacgggtgcatatcctgtaatcaatcccggtattgagcaaacaggcacaaatgacacccagcaagaaaaatgacttgctcaagacaccacagcaagttcatggttttctgaactgaattccaagtttcataacttctaattaatcctcctttttttcccccagtacagctaatatgctttttgtgaataataacatataataggtgtaatctgtcagaactatttaatagttgatagtatgtatcctcagtttattgaggttcaagctcttctgagtattataatactttctattggtattttctctcttgagctattccctaccttgaatctttcagactagagatttcagaagattacgtagtgtctgtgacttcaactacacatggatagtccacaggactctggactttcacggttccatgtcagttggacaggtgttactctaaggccctgcaaaaatataaagtagtttgagaatcactctcctgttaatcttcagtaaaattctgagctatttatatgtgagattgagaggcagcttggtaggatggaaagagtttagactttgtagttctactgccccaggtttgtatcccagctttatttcctaacagtgtagccttgggcaaattgcttaacctctccgaggctcagtttcttcaaataaaaaaatggaataagccttcccttgcagagttgttaatattatatgaacgttatatatgtgaagtgcccaactccttgcaaatacctaatatacaccagcttccttcccaggcttttgctggtcagatctggtttccacttaactttggctgttggaagataagataatttattatgaagataattgtctggtaattgtcatgagaattcagttgatgataattgaatgatttgtttacctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggattttgaagacggagtatgatctttgacagatggtgttcggtgggaatgaggaaaaagaaaggtgagcttcagccagggattggaggtggaaaaaatgaacacatgggtggcgatgattcaggcagaggggcaggaatgtgaaggaactaagacataaaagtagaaagacagtttaggcctggtttatgagggggtctttgaatggcaaactcacctttggtggtccacgggaaggtttgttagaactgcaggagtgtgcccaaacctatatgtcaagccactaactgccagccatcagtttgaaaaccgaagcaattaagatcgctgtccatcttacctgaaagggaagctttgcactctaacttgaagtagcctagaaatttcagaaggttacatagtgtctgtgacttcagctacacatggataatccacaagactctggacttattttcactgttgtgtaatagggttagttttgtttttagcagattctcccaaggaagtgtggtaatcacatttctcaaaccattacattaactgctgttagcaataaattattgcttatgtgctaaaagtcaaaaaaagcttttcccctttggaacttctttactatactccctgatatgttttgctgtcctagaaactggtgtttgtgtgtgtgtgtttgtgtgtgtatgtgtgtgtgtgtgtgttcaattgagtcaagaacagaggagaggagactcaggctgaaaatgtcaagttattttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatcccaacttaatttcctaaatctgtcctatctacataccacaaagtgcttaactgagaaattaacttctgtgttacagataaatggaagttagattaaaaggataatacattttcatttttagtgttcttaaataatcctttttattgtaaataaatataacgttaactccgataagtccagactacttcactgagttcaccaccgaaatgttttcacaaaatcagcatcgttataccttggcttttataagaagttagtatacgaaacttgtataggaaaatgtctctgtattatctatgaaactgttaataaatatgttttccatcatgtccatgtcatcgtttacatatacgagatgatttcctcttagaattcattctaaacttctttaacagaaattatctttttttgattcatattctcccttttgtcctggttaccagacagcacaagtgaccatcatgtttagatttctgatacagttctctcttccattcctctctgtagcctctgatttttttttcagacttcagttggaaaaatcctaatgaatgtaacttttagttacaggttgaattcttttgaatgtgtatatttaaaataagtaatgcacatagttaaaaagaaacatgtttttaaaacagtggttctcaattatagctaaatatttagaattatctggatggttttaaaactctgatacccaggcagcatcctagatcactcaaatcagaatatctgggtttggtcacggacatcagtattttttttttaaagctgcccaatgtcattccaatgttaagattcattgttttagatattctttattatgatgttcatcatttttacagaaacacatttccaaaaggataaatttcaaaatcacctgtaaacccataatttattataagtcactcttaacacctaaaaatagctaacctgctaacctttttcttttgctttttccttcttcttttaaactaaaattacaataatatatgtgcatatatagtgaatgtattcatttatatattagacacaatttacatatttatgcttatatatatatggcatacatgtacacgttacaatatgtgtatttgttttattccaaatctgttttattctcagagacattttcccatatcttcccagatatattttctgagaacctggtttttaatgcttgtataacattaatacttgtagttagaccattttttttactcattcttctattcttacatattaatgttgcagacaacatccttaaacaacttttgtgtgactaatccaatttttttccttgggaataaattatgatctattgatttatttctatgtgggctgaattttgtccataagaatgaaaatggtagccccctaagatgctgtttgctccctgatatctcatttttctctagaatacgaaggaatggctgttttctgctcttcctaaagattcaggatgtaataatatactgtcacaggtttcagaagcatgggaccttggcaccgaaagggtctctactagctaagttgtcttggaaatgagtgggtccacttcctcttctgatacaggaagaacagggaggtcattaaatgatgacggggctctttgaagtgaaatgaagcaacattggagggtgtagcatgtaaaaactctcttctcggatacaaaaaaaattgagctacttgggctaggagaagtgagcctggatttggaggcttaaggtttcaggaaggtctgagacaaacttaagaagaaatgcatcaagagggttggaagggacagacgattgatgagagcactgaaattccagtgtgatttgggtcacccgtgtgacatggcatatatttatgggatacctggaaaataagggagaaacaagacatctatctctgtcacactttggggaagtatacgattaagttccacactctgtggtggaaagaatgtcctggaggcccccagtctttctcactgtgatgccatgctcatttgataacctcataaacacatttctgttcttattgccttacccattctgatgcactgatcattttttaggccatgtgaacagggcagagcttgtcattatgcctgggacatagtgggcattcagtaggtgtttgttgaatggaagaagcaggcacaatcacagctttcccttctggtgatctgctttatgatacaatttccaggaatgcattgtgtctaaaattggggaccatatgtacaggaaattctttcttatgtcagtgtgaaatccctccaaagtaaatccccctttatggttttttattggtgtttattcttttttaatacagaaaactgtaaactttttattagggcaggtttttttgtgcaaaagccttgtcatgggctagatgacatttcttttcctgtagagatacttggacattttataattcaattacttccttccaaaagccatatttagaattccagccaatctgtgagccagaaaggagtgagccagtataataatcaaggtaatgtggcaagaaggtgtgaaatttcttagcctttctagaagagatgggtgaaaataaatgttttcagggtcagtaaataactttcccctagtagccagacagaaagcatcttactttgctcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtgagagagtaatggaatgtgtatgtctctgctcttgaagataccaggggcacctcgaaaactcccctccccagcccagggtcaccacagccttaaccgactgcctcctttgcaaacctttaccatgggtacctagaaaaagacatacacacacacatttcagcttatggtttttgttcgtttgtttttgttttttgtttgtttgtttgttttgccagatacttaagatttaagggcaatcttaagggaaatctcttctcccatcttgactgaggcacagagatgtcctgttcccatgctgttgatgctgacagacgtaggacacgtttttttctccgtgtgccaccacactcaagcagaatgtataagatattttctgtctaccaaggatacctggtgacataatcatacctagcctttctttcctccctccgccccctcagcctctcaccctgccctcccatgggtctttatgtgtgctactctatgtagagtacaactcataccggatagcctgttacttattttggttcaggagcagctgcagaggatgaactggagaggacagtctacttgcaaacacttgtagactctccagtggacaggttacctctaaagaaagagaagcctacgctttcctactcactgaagttttttaccatttgcaagtggatccaatatatgtttgttttgggtgaggggctaacaaaatgctctgcggtttctgcaggtttccttataggagatcctgttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgatgataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatggattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacagggagtggaacagagagacagaaaatattgggagtcttgtgccccatcagtagaaggagatgaaggccagagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactgtgtcctaggcaccactttagttcttgagtggtcagcagtaaagaaaacagacaaaaaaataataccctggtggagtttccattctagtggggacacaataaacaaaataattggcaaattatatagaatattggaaggaagtacatgctgggagagaaataagctgggagggaaaagggagtgctgggggagaaggagctaagagtctcagttccagagttaggcagcctgagctggaattagaaccccagctgcatgcagtggctcatgcctgtaatcccagcactttgggaggccgaggtgggcggatcacctgaggtcaggagtttgagactaccctggccaacatggtgaaacccagtctctactaaaaatacaaaaaaaaaaaaaaattagctgggcatggtggcgggcacctgtaatcctagctacttgggaggctgaggcaggagaattgcttgaactcgggaggtggaggtttcagagagcagagatcacgccattgcactctagcctggcaacaagagcgaaactctgtctcaaaaaaaaaaaaaaaaaaaaaaaaaactcagctgcatccttcccagtcatgtgacctgggcaggttaagagaactccctgagcctcagttttcttgtctgtttatcaagagtcattagggaaactagtatctccttgggttgttgcagggattcaatgagatgacacatgtaacacaatcattacctcgggcctgtctcctataaatatagtgattgtcacgtttgttatttaaacaatattatatattgtgttttaggtattatgtatgtaatatatagtgtgaatatatgtatgcgttatgtatatagcattatctgacttcgtgcctctagtattacatgcttctcaaaatatctatagttttgtcggtatttctttctcctactagattgtgatcttttatcggcaaagaccacctctcatttatctctataccccccattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagttgcatgttactaataaggaatcagaagctcagagagggggaatgaaagaatccaagtatatgtggctaaaattggccacgtcgacacctgaaatcctattatctggggcaatatacatactgggtttgaaaaagttcacacttagcagttgaatgacctgagtcctcaccccagcttggctacttactcaccatgtgaccctgaatagtgccttgaagcctcagggtttttttacttctgtaaaacagtaactcttgccctcccggacacatgggatagtttgaagattaaaagatacattggctgggcatggtggctcacatctataatcctagcactttgagagactgaggcaggtggatcacttcagtccaggagtttcagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattgattgtaaagaatatagaatgcggaaactcatttttaattattaaaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcgcttgaacctgggaggcagaggttgcagtgagccaagattgcaccactgcactccagcctgggcaacagagtgaaactccgtctcaaaaaacaaaaaaaaaaatgcttccccacacccacccccaacgaacgaacaaacacacttaggaaatagggaagaaggttatgttttgggacaactttctatacactgagaaaatccaagaggtctccacatctacctataaaattcagtgatgctcagagctgacatgtcaatttttcctattacatagtaagaagctcagcattatgggccgagtttattggacactgcagaaattcatttacattgtgtgcttaccctggattgttgttgagtccagctgactgttgcttcacaaattaactgtcctttgagacttggaaatattgaaattgcatagagtttttgtgaaatctcaatcctgtagtattgtgtatattacaacaggtgctcaatagacttctggattattaaattgagtaatatttgtagcaaagatctgtaggctgaattataaagctaatctgtggggggatgccaagatttctctatcattctgctatgtttgccatggtctaccaggagatggcgcctggtaagagttccatattttaatgtattctggtccaaatcactggagttggcaaagatggagaaggaggaactgagcagttcatccccaaagacatgatgacaccactataagtgtgaagccagcaagagtgcaaagactgagagcagcgtggtcatacctagacatttatctggagagcaaaatcaagcactggggctcaaagggttcagtcccagcagttaggagagagaggagtctcctaggagtagttgccccaacagctgctagaaagtcctgatcctttttggtctgagccaaccaggtctcagcccagtcccacttgcctcaatttaaagtgacatttttggtctctagctgggtgcttccccctctgtagcatataacaaggatacactttcaaggcagggagcctggaggacaaggagataaccctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgctataccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgttggggtgtaacttaccatgattacatgttgtgatatacgagtccatctcagcagatagagagactctccttgacagcttgaggaaataagtgaccatatgagagaagctcatgaggcaaggagctgtgagcaacctttaggagctaaggacagcttccagcagacagccaacaaaaagctaggatcctgactcacatacccacaaggaaatgaattccgccaataatctgaatgtgcctggaaaagattcttccacagccaaccctccagatgagaatgctactcagctgacactttgattgcagcctgtaagactccgagtggaggacccagccagagtcatgcctgggccctcagaaactgtgagatagtaaatgtttgttgttttatgccactgagattgttagccaacaatcaaaacctaatacaataataccctttactgttttctagacagctgctatttagaaaagcctcccacccaataaaagagtcccctttatagttttccaagtaggtggttatcagggttctgcttcaccatcttcagtggcaaggaacttccatttcacagggcaaccatgtgtgtattacagaggcttgcatgttgtcaagttcagctgtggtcttcagcgggagcctaggacatgccagggatttcaaggtaggctggtgaggggttcctggttttcttggtcctgaaccatcccagtgccattctaacagttgcaagtctgcctccttcatgacaaaaggactggaggaaaatgtatctggcaagtcgataacactggatcgtttgctcccagctttaccacttggcatcagtgcaaactttcacccagttaaataacttaatgagccctgctctgcatgcttgcttcacagagttgtgacgatcaagtaagacagcatctatgacagtgtttgttggctgtaagtcagcaaatgattgcaaatgatgattattattaaaataatagtcatttgtcagtaaatatttgtcaaagctggtccacactgagggagacaggctctccagggaaactgctgatgcagagataaagaggagaccagccccagtttggaattgcatcactgattctgaattccccatggtacatttcaggtcttgcttcaggaatttgttttttgttttgtttggtaggaacaagaatcccctagagccagttatgttgtcatcaaacttagttgctaattaggcaccaaagcaaacctatgccagtgagacagagttgaaacttgaattcctttctgcaggtggagcgttggatcctagaggcggtgtatacagcttggctattttgatgcttctgcatgcaagaaggtttaagagaatctgagtaaagcaattagcatccctctgtctgcaggcaaaactggtttggacatgcttctctcttcttgaagggctgttagagccttggcagtgtatctgacgaaagatttcactaagcaaaatgtcttcacttacaaatccagccactttgcactctcagtcagcctcaaattcatttattttctttagagtttccctacaaccacgaaccaccaagaattaaattaatccccaagagcctgagcaattatgaggatgttgaatctatccattcaaggatgtcccagcaaggactgttcattcttttaacgtaaactatttatatgttttgattctcctcatttggaagaaagaaataagttttcatatatgtatttttcagggtgtattttatatatctgtttatattacactgttcacattactattaaagcatccccattttattgtaagtttattttgcctgcttcgggaagaacaagaccaagatcccattattaaaaccaaaatcttccacaaaagtttccttttaaaaacttagattaggaaattttcagtcagccagccaactctatagcctttgatacttggtcctacaaagttttcttcccctttggtctgaatgttttcctttgtctgtgcacactctattctcctgccagcatgataatacatgctgctttgatatcaagtggcgggaacatatagaaatgtgctattggtgctgcaatttgtatctttgttttcatcaaacttattatttaccattttaggatttttttgtttctttttgggtgtttttttttttttttttttttttggtgtgttttgtttgatcttggttttggttttccaatctaggcctgaggtccagtgctaatttgatgctagtgtgaactctctgagcctggttccttgacgttccattgggtgactattgcagtggttcagatgtggtgctaccagccttccccaccaaggaagttgcctgctttctcatctttgatcctcttcaccaactaaccacaacacaccagtgaaaattttaatttctccattcagttcctcagtttccgccaccaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagacccatatatcaattatttgcatccttcaattaacccacaagaaggcaaatttaatccagtgttagataaaataattattcacagggtcataacactattaaagaataagctatggccaggcgcggtggctcactcctgtaatcctagcattttggaggccgaggggggcagatcacttgaggtcaggagttctagactaccctagccaatatggtgaaaactgtctctactaaaaatacaaaaaaaaaaaaaaaaatcagctgggcatggtggcagacgcctgtaatcccagctactcaggagctgtagtcctagcattttgggaggctgaggcgggcggatcacttgactaccctggccaacatggtgaaacctcatcctactaaaaatacaaaaaaaaaaaaaatcagctggtggtggtggcagatgcctgtaatcctagctactcgggaggcggaggcaggagaatcactcgaacccgggaggtggaggttacagtgagccaaaattgcaccattgcactccagcctaggtgacagagtgaggctccatctccaaaaaaaataaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccattcttacctaacagggaagctgtccataaataaggtagcaattcctgaatcaaggacaagccttctgcccagtctttatatgtaaagaaacagtagtttcatttgaagggaaaccattataattgtctcagatgtgcatcttgttccagggtacttctttgtatttttgatgaggaaccaaaggctttattatagatcttgtgaatacctgtcagccaggatttagaacaaatgcatttgggcaattttgccttttatttcagataaattttatatgttgtttctgtccagaattgtaggatcatgtttggcttttcaaaactgcaggaaatgtttattttacttttctttaaagaagaagacagtaatgaaaaatgtatcgactgccagcccactgtttttatttctctttgtgtgagctatggcttctccacatcttgagccttaaactctttgatgttgtctttttaagcataacataaaagattattccctttagtctgtaggcttggaggtgggcaaacatgacatattcctgggtattcatatttctataacaataattgatgcaggttttggggctgttgtatttgccgtagccttatatgataaacatttggcattccatgacgtttcagctttgtcaactttccaatcctgtatggagttccctcttattgtttctgtgtgaacaacttgacaagagtggcatccgtggtcagattcttcactctatccctgcaggacttttcattgtgctctgcacacgatggaggctcaatgcatgaatgaatgcatggatgaatttttcagtttgattccgtgagctgcttaattctattagatgcgctccctaggcttttataagacgtttaattggtacatgtttcttatcactttttaatactccataagtgttttgtgttctttgcagtagagtccaaataaatataaattaaaatgtttccaattacagaggaaatattttcagtatcttcccacaaataacactgggtttataaggcttggttcccgggtttcatggtcatgcttggttgactaactttgtgttcatgtggcataagattctaaactgtcagaactacgtgggcttttagagcccatctaaatccttctcactcacagacgagcaagctgacatatttgcctcatttattggcagtgaatgaattaaaatattgtgccttcatcaagatattgtgtgtatattcacaatgttgtttttcataaatatgtagcattactctgttttgtgactgctcctagactggctggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacataataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccagaatcttttccacctttgagattattttaaatatcatcattactttgagaaaagcaaacttaacaaggatgccttaagaaatataaaggtgtcattgcccaggaggcaagaaagggaggcagaatggtaatgaaatgagacagcccttgctttggttttataagatctgggtctgaatcctggcagtgtgttctttctaactttaggtaattcaggagccctagaaacctcatctctctatctagtgtgggaaaacgtgaaacaactttgggccatagattgctctatgcaaactcaacatatgcaaacttgtcttattaaaaagcctatctctagtggttcctatccctagtcttgtttggttgggtagcttccaattaataacagcttcaaattctggctaatatttgtttagcacttcatggcttacaaagtacttcattattttaacattgtagtattggtaataatatcaaactttctgttattacaataaatgttccttttttactttattattccattactttattactgtttttcagatgtactgtgatctacattttacggatgaaaaaaagattctaggaggataagggactttgtcacaaaagttagcttctaaatgatggggggactcatatgcaccttttgaaactcctaaacccatgttgattccccaaaggctttggtggtcctaaacatttgacataatcagagtctattataaaaaggtatggcttatccagctcctggttcctcactgtctcctctatctcaaaatattctagaaaaaactttactccctgaaaatatacagctttaggataggtgcagctccatttcatactctgattttcattcctcatttgaaaagttgaagcgtaatttcttataagactttagaagttgaagtcaggactggataaagaaaatgtggcacatacacgccatggaatactatgcagccataaaaagggatgagttcatgtccttttcagggacatggatgaagctagaagccatcatcctcagcaaactaacacaggaacagaaaaccaaacaccacatgttctcactcagaagtgagagttgaacaatgaaaacacatggacacagggaggggaacatcacatactgggtggggcctgtcgtgggggtcgggtgcaaggagaaggagaggattaggacaaatatctaatgcatgtggatcttaaaacctagatgacaggttgatgggtggagcaaaccaccatggcacatgtatacctatgtaacaaacctgtacattctgcacatgtatctcaaaagtaaaattttttaaaataagaagaagttgaagtcagggtataggaatcacaatttgcagtgctatctttcacacttcttaccacctgatgaaaatcaccaaatagtatttcttcttttacctaacatctctaggaaagagagaaccctgactgcacctacaagtagggaaaggcatttgagttacgcaaagctgcttttaactctgaaactgtcctacagtgtagcatataaacagggaaaacattttattggtgttttaatagaatcttatctaaatatctggaatcttactgcaagggccgatcattactctaggtagatttcaaggcccacagctccattatgatgtcaacaaggataactgatgtttattctgtagttagagcccccaaggcttcagcaaacattttgctcatcacttgtaggactagcagtaaatgtaatcattgcaagactgagctaacacatctgctaacagggttgttcatttgagtaaacagcaaggtgataaggcgcagggacggaccattggattgagtcagacaggcccgagtacaaaaaccagcctcactacttaaatcttacatagcccattaagagtaagttgcttcactttgggaggctgaggcggacagattacgaagtcaggagatcgagaccatcctggccaacatggttaaacctcatctctattaaaaaaaaaatacaaaaattaactgggcatggtggtgggcgcctgtaatctcagctactcaggaggctgagggaggagaatcccttgaaccagggagtcggaggttgcagtgagccgagatcactccactgcactccagcctggcgacagagtgagactccgtctcaaaaataaaataaaattaaattaaattaaatttaaaaaagagtaagttgctcaactttttaaactttagttttattatccacaaataataaattataaattgctgctttacatatatgatataaaaatgcatcaatccagttaatttggggtaaatggtattattccagtcttacctcctagaatactcagaagacacaacggtgtatcactagaaggagatagttttgttttggtttggtttggtttcttcagtcttctttttcctattccttccttttccaagaaacccacgatttctttctttctttttccagctattgatgaggtcagggagtaatatgttcagatctttgttgtatctttgttccgtttagaaaccagtatctgggaattcaacagagaatttggggtcactggaagctatgttttacctacatacaactacatcttcctcttagacctagagactagatactgaaaatgcaaaaggaagccatattgacactcccaaggataagggaaggcattacatcatcctttgtaatggtgaatcttgtgcatttgtagagggctggactttggcttctaccatattgtttagctctgtcaaccccacacaaggactttatttatttatttagacagagtcttgctctctttcccgggctggagtgcagtggtgcaatcatggatcactgcagccttaacatcctgggctcaagtgatccttccacctcagcctctcaagtaactagcaacacaggtatgtgccacctcatctgactaatttctttttaattttatatagatgggatctcattatgttgcccagcctggttttgaactcctggccacaagcattattattatcctcatcttacacatgaggaaactaccagtgaagtggcttgcccatcatgtgaaattacatatgccagtactagcctgttctgaaatccagcaacattcttttccacctctagccttgtttctagcaccctttggcctccagagcaagctggggttcattttacattaaaagtagagccatctgatgtggcgggcatccaaaacacttgggaaaatgctactctgtttagaactcgcttttcttcctcccgggtcccagtgcaggaggtactgtgtgctatgtgggccatcagactgtccctggccatggcaggagaattaggagaccaccagggctgtagttaactgtaggtccttcattaagaccagccaattgatagcgtgtgttcatgagtccttgtgaagtcttttcatcagccacgtggaagaccccttagaaaaacaatctctgtaatttgtatttttggacatagtgctttaggaaggtggatgtctgaaggtgggctgggtttgaaacatctctcaatgccatgggacagtgtggtacagtgtcctgacaacttaagctcatcctgacaacttaagacactaaattctactcctgcctcttctagtctagttggtcacctgccctttctgaatttgtttttttttttttttttgagatggagtcacgctctgtcaccaagctggagtgcagtggcacgatctcggctcactgcaacctctgcctcccaggttcaagcgattctcctgcctcagcttcccaagtagctgggattacaggtgtgcaacaccacgcccagctaatttttgtattttcagtagagatggggtttcaccatcttggccaggatggtctctatctcttgactttgtgatccgcccaccttgggccactgcgcccagccctgaatttgttttcttaactacccatttatttgcttgaaacagatgacttaaaatattccttcctcctctgaagttgttctttaaacttttctatgtaagaaattgattgagctgtattcctaggtattttattctctttgtagcaattgtgaatgagagtttactcatgacttggctctccttttgtctattattgatgtataggaatgcttgtgatttttgcatattgattttgtacgctgagactttgctgaagttacccaccagcttaaggagattttgggctgagacgatggggttttctaaatagacaatcgggtcatctgcaaacagagacaattagacttcctctctttctatttgaataccctttatttgtttctcttgcccgattgcactggccagaacttccaatactgtgttgaataggagtggtgagagagggctaatttacattcccaccaccagtgtacaagggttcccttttctccacatcctcatttgttttttccagaagacagcatttgctattacctgtcttttggataaaagccattttaactgaggcaaaatgatatctgattgtagttttaatttgcatatctctgatgagcaatgatgttaagcagcttttcatatgcctatttgccatttgtatgtcttttgagaaatatctatccatatttttcgcccaattttacatcagattcttagattattttcctatagagttgtttgaactccttatatattctggttattaatctcttgtcaaatggatagtttgtaaatatgtttccctttcactggtttttgtcttcattttgtttgtttcctttgctgtgcagattaacttgatgtgatcccaattatgcatgtttgctttggttgcctgtgtttgtggggtgttactcaagaaatctttgcccaatccaaagaacattcatctttgtcaaatgagctatagaattaatgtttttcctatttttatttattcattttatatttatttctattttatatattcatataacaatatatttattcataatatcactttgaatatcatttgttttcatcttgcatttttctcatttttcattgaggcctaatttacatgcaatgagatactcagatcatgagtcgtagttttaggagatttggcaattgtatatattacccaagaaagttcccttaagttcccttattcctctttctattcaagtcccatctgccaccctcagaggcaatgactttctgacctctatcaccagaaattatttctatatgttcttttaaatcagataagaatcacaccatatttattttttgtatctggattctttcattttgtgcagttgtctgagattcatccatgttgttgtattagcagtcttcatctttttgttgtttagtatgccacgattataccataattaatttacccatttttcttttttatcataatcttatataagggaaaaacatgggaatacatgaactgtatctttggctcaaatccatcttctatcagttctaagggcctcagggtatttgccatgaggggctgtgacaccagcctggactattaggaatggacctttgcttctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccctctctttagcatttctgtgaggaagtatccaaagcattggattacttgagataatatttctggtcctcttcctctctcacactctacactttgcttttctagaattgaagcctggagaagaaatattgtctaaagagcttgctacaagaaaatttccctaaaaagtattgggtcttaaaatttcatctcattttcaagttcttagaatactgttaatttgcaaagctgattatggatggcatactttattatgctttttaatcatacttcaaaactgcactatggatttgttctttctgtcttcctcccatgcttaatcattatttttggtggcaccttctaaactgttgacttattttctttctttctgatttgtagtagatgttgtataatctaagtttaggcagagatagtgaaagtgctggcctgcctgtatttcagccagtcctgggttaatattattcatgtggcaatgtctgttttactttaggactcaacgtatttaatacttcctctcctcctctttacaatacatagaggaaaggcctttgaaacataatttctctccctatgggaaatgctttctataaatttttcattttcaatacaaactgcttcactttacaaaacagtatctgtccctagcatgaaaaaatactggagggatatgaacagtaaaggagaatatttttctagcttgtgttaaatcaataatgtagtgattccaagggaattgagaggttcgtgtatttattcatatattagtcaaaaattcaaaattctatctctaattaaaaaggaatttgagaagtatctaccatttttattgtccatctctttggacatatgctttgcagcacagtggagcggaaggagcgtagacctacagaaatttagagggctaaatttttaatattggcctggctacattgcctggactttgggaaaatcacttaagctctcttagccttagtctttttatctgtaaactgagaataataatgccagtttttcaaggttgcattgaggatcttaggtaatacatataacattcatggaacataaaatgtgaaccaatgaaggtgccaatgcaattacaccttcattaggagttgtcatttctgcggcttctcattagaacatcaaaattagttccttcaatctttactgaggcgcagagctttaaactctaactttgaaacttccaaaatgaagtgtgaaaggtctgaggccttgtgagtttgaaaatgcagttcacacttcattttagaagctccagaattttttaccaaattgagattggattcaggaaatcatattttaaagccctggttcatgccattttctaaagaagtacctagaaggccataatcagaatgcttattaagtgaccacactttgaactgcattgcagataaattacctctgtgtggggagatgtgtcttgagattctgcggtcaaggctcagacagccccagagctggaaacctcagagcatttatgcctctgtcactaaaggatggggttatgggggctggacagaaagcttgagagagatgaaaagttcagtgggcttgagggaggattactgaattacaataatatccacaccgtaaagtgaatttgtacttgcaagagacacattatttatctagaattttagaaagggtctcttttcaggtcactgtgtagattgcctgtgatttgttctccttgattgaatgtgagtgagtgtgaagcatatctaaacaggtctcacagcaagtttctttcataaatctcctctggtatatatgctgtgtacccttgacaaggagaacactattaatggcgacagtatgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcgaggctttgtctttgtcttctaagcttgctttcccctgtgatgtccagtctctcctaaaccagataaggattcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccgtctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgacagagcaagattccatctcaaaaaaaaaaaaaaaaaaaagagagagaaaagaaaagttacatgtagagaactgtaagtaatcttatctggctagaatatagggtaccataggggaatgactgagcatgggtcagagttgtaaacatccttatcatgccaatgagttggatttctccagaaggcatagagagatctgtttatagtttctaggtaagaaagagtttatgaacttgcctgtgtcttcgaaatatgctgtggcagaatagaaaaggtgatcaaccagagtaggacagaggccacacacatctgccctgaggtcagatacctatacatttattgtgtttgatagccaaatgattttaatgtaaactagttgcaaacatttaaaatttgggaaattttacataaaaatctagattttcgagcttctattaagaagtagagtgcacaatatctgcctagcaagaaacagctgttgctgagaagtgtcttccaccttcagctagagcatgcagtctgacatttgcttttctggttcttgtatttgagtgtgagactcttggagtaaagcaaacccagggtcagaaagatcactggtgatgatgttgcagttgtactgtcaggactgatgaaaacctaaactaaggtggaagccttgaggaatgaagaggagggcaaggatggatttgctgattgtttagatgtgtcatggatgaaagagatggagaaatcaaagaagactctcaggttgtaattttaggtaactgggtaggattcccatgtagtcagaaacccagaaagaagagaaggctttgggaagatgacagtgtattcaatgtggctttttgtggttcaagactttggaaaatattgattagactgttgaaaagtacttataggtcaggaacctggtcagaaagtattgtgctaaaataatattgttatgacccaagcagttgtaaaaataacttttattgtctaactctcacagtttatcttgaactcttaacaggttgtcaggcaaatatctgttcttgaaaccagaaaaacaaatcaagaaattgggatatttgaaatgcctagagtgggcttataactgtaaatgatattttacaatggaaaagtagaaacagtctttagcagccaatgtgaaataactgggtaatgttatttaatagaatgcaaatttgaaatgagtgataaccattatggagaattttgttaggaaaaaaattaataaagtgaatgtaacacatgaagcagagctggaactaggaagaaggaagtcaggctcctggggaaccaaattaaggagacttcccctctcaggcacttgtgggaccctgacggtaagcatctccttaggtactgctcccatcctcatccttgccttgagtttttgaaaaatatatgttagaaatgtttatgattatatatcacaaactgttattctcaattttatgaaattccctagatatgattacaatagtcatttgagatttatgatcttatctaattgttatgtatgtacccattgtggggtgatacaggcagaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactatttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgcctagcatgcgaccactgtggagtgatgccagacggctgtgccattccagtgcactgaggacggagggacccttttcctctgaggacacatcatttcaccttaacccctttggccagaacaaagttgcatagctgcaaggacgactgggaaatatatttattctgggcagccatgtacttagctacaatttggaggttctaaagaaagaaaggaagagaatggaaacaattttcaaggcctaccacagcaaattggtgccatttctaggactagtatcctatttcctaactcctagtagaatgttttttctataccacagatttttaattctcataaagatgtgatttttaattaagaagcctataagaacattttgaatatgcacaaattcatcattttatatgtccatacgggatgcagtgattcccctttgcttaagatcaatttttgtttttattaatcccttgatatatagataggagtcaggcagacccaagtttaatttctgtctaccaacttgtgactttgggtccatatgaataaaaaaatctatgctttgattttgttttttcctctctaaaatagtaacaacatgtcatcttggggttgttttaaaaattaaatgggatgatattaatgaaagagcctagcccagtgtttagtattgaataggtagatatctaatggtacagataccagtttccttctttctcctcacttccttaggttccctccaacctgaagacaacgtatgtttctcatagataattacaaggaatttaaatccttgacaaaatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcacttaggcaggtattgtgattatctaagtgagagatgatagaacaatatggcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatgagccaaactcaacaagataaaatctaagagggtcaagtcaaatttcattcttacctttaaaagttagctatacaagtacatcatataaatgtcatttactttgatagctgtttatattttttaaaaaaagaaagaaaacaagactggtagagaagatagtctgaccgcaagatcaacaataataataataatgtaggaccacagaaaagtaaatgaaatcttggactgcattcatctaaagaggagcatgcagaacagggaagcagcagtgcctggagtgctgagttcagttctgggcgccacatgatgaagggaacctggataaactagaccttgggcagacaaaggtgcttgggagagtgaggtgacagaaatttctcataaggaatgatggaaggtatccctttattccaataaaaagaagactaaggaaaggcaatgttttcagtgctctttagggctgttaaattgaaaaggcaacagatttgtctggagaggacagaagtagggccaatggggaagaagatatttatgtcaaaataagaaagctctaacaattagacctaccagtggaatgaacgaaccaagagagtgagctgtccctggacatggtataagcagcctcaggggctggaaaaacactgactgactgggaatgttgtagagggaatttatagatcagattgattggggaaaatagccccaaaggttctcctctctctgacatcactctatgattctatgtgaagttctagctttttaactatttttttgtataattaaataatttgtctttattgattgagaactaatcattaaaaaagctactgtcttttcatgtctagagatgataagaataatactacatgcttttgaagaaaaggaattttatgcaaataatcccataccagtgtattacgcttttgcagggataatcaagagcttgcaaaatttgaaaccacattttcccctgtatggaggaggaaagtctattttgcatccgtactttatgccttgggcattattattgctcatatgctctaggatttttaataaacctaacctgcttcatgaaattacactgcattaattcaacatggccatgtccaaaatttaatattcattcatttattcaagtatttattcaacaaacaatccctactatatttcatgtgctattgtcagtgctagaaacatcaatttaaaaatgtttaaatcctagtcttcgaagagtttataattaaatataaaaatattgtctatgtgtcaattactgtagctccaaatacctatttactccaaaaattagtgtctgaaaggaacaatcatttattatctcttacagtttggtgggtcagaaatttgatagcatcttgggccaggcgtggtggctcatgcctttaatcccggcacactgggaggctgaggcaggcagatcacttgaggccggggagttccagaccagcctggctgacatggcgaaaacctgtctctactaaaaatacaaaaattagccaggcatgatggcacgtgcttgtagtcccagctacttgggaggctgaggcatgagaatcacttgagcccaagaggcagaggttgcagtgagctgagatcatgccactgcactccagtctgggggacagagtgagactctgtctcaaaaaagacaaaaagaaagaaagaaatttgattgtgtctcaagtgggcaagtttggcttggggtctttcatgaggtttctggtgtgaggtctctcaaaggctgcttctccttacacctgggccaggagtgtttgaacagctagtctggaacaacttggggtcttcaggtatctccctctatctgcatgtggtctctccagctttgggataacctaacttcttacatggtaactgctatagtttgaatgtgtcctttaagttaatgtgttggaaacttaattcccaatgcaacagtgttgagaagtggggtataataagagatgattaggttatgagggctctccccttatgaatggattgatgccattattttggaagtaggttagttattgagagagtaggatgttataaagtgagtttgactccctcttgctctcttgctgtcatcctctcttgaccttctgccttctgccctggaatgacacagtatgaaggccctcaccagatgctggcaccatgatcttggacttcccaccctccattatcataaaccaagtaaatttatgttgttcaaaagtgacacagtcagtggtattgtattatagcaacacaaagcaaactaagatagcaactgaggacttcaaaggtatgtatttcaagagaaaactatatcacattttaagattagcattaggagggctgggtgtggtggctcactcctgtaaccccagcactttgggaggccaaggcaggtggatcacctgaggtcagcagttcgataccagcctggccaaacatggtgaaaccccatctctactaaaaatacagaaaaaaaaaattggtgagcacagtgtcgggcacctgtaatcccggctactcaggaggctgaggcaggagaatcgcttgaacccgggaagtggaggttgcagtgagccgagattgtgccagtgcactacagactgggcaaaaagagggagactctgtctcaaaaaaaaaaaaggttagcattagaagtcaggcagcatcactgctatgacattctcttggccaggcagttgcataggttctcccaagacctcacctcttagtggtggactgttagtatcacattgtgagatgggatgtgttttggtgtagtcatctttgaaaattacaacttgccatagcatatgaacagataacactatacttgggttctctgctatggtgctgtgaaagaacagaagaggagagtgattaacagaagaggtaacattcacatatcatgggccatataatttgatgtatgtaacttgttaaggaaatacgttcaaggcaggggcaacagcaggtggaaaggcatgaaagaacaatgagcacaaagtgtttaaaagcttgggttgacaggaacaaagactgagttgtaggagaggtgacaggctaggggcctagacaggggaggtaggacagcatcctgaagggccttgaacatcaagttaaaacgtttggctttggggagcagtcactgtctttagagcacaggcatataaactgatcgtctttggtaatctcttccatctacaatctttctttcctttgatagtaaacatatcatctctgttaaagttgcttcctagcttaaactgaacacagactccaaaccattgaagcactttagatttttttcttttttttttttccttttcttttactcaccacaaacaactctagaatggcatgcatttgaacaaaccaaaagtgatttcactcttctaattttcagtgctttttggctaaatgcagagtgagaaattcatacctttttcaagcagtgtgggttctttttcccaatttctgtcatccatctggttctctggaggtcttggaatccaggaaagtgttagttcactgtgctgaaatccaaaaaagactgctaaactgtgaaagaaaatttgcattccagagacactgaaagagttagtccaccacccttttgcaacagcaaggagaaaacatctgtatttcctgcctctttgtctttaagcagttatagaatggaaaaccctatactccctggctgtgcgtttcatacctagttaatctaaatcacttttggcagggtgggggaggaatcaaaacatggaattattttatttctagtgtcagaaaatattacagccaagatactgtttaagggaagcaaattacttcaccagcttccttttgagctcctcatgaggtttaattctcatgaatgggtcctagagccgacatttgacatacacatcagcagtgccctcttcggaagggaaccgcacagtcacagccatgatgttggcatgtctttatggccttcctaagtcatgtgctgtcttttgtcttccattggcagaaatacaattagaaggccttgttctcaacagaagccaaatgattgccaaatctgttcaactgatctctagagaattgaagttagctcatggccctctggctgttctctttgccactcccaggagttataggcttaaagttatccctttcttttgaaagaggatcaagtttggttcaaagaagcttttctatcatccccaggagtacaaagagagcccttccatgaccctagttgtttggctcagaccacttatagcttactgtaatttaggaagtaattgtaattcataaagccaggtagataataaacatcttggcagggttgagtttcaggcagctctgaagggaaccaacatgtgagtggaatggtattgggaacatttctagtctctgcttgcagatcttgattctaatggatgactcaaactggtttaattctgatctgaaatgtgcaggcaggcagtcattactctgtatacacatagctgaaaacatcatcacttaagcatgggttttagacattctcctggatgagttagttacccatggtagacaaatactgtaagtaaaaagagcattctcctaatttctatgttgtgtgattaacttcagatcatttatattcctggagaaatatgtagcactattttttctttaaaagatatattcttgctgaggtagaataaagaacagaaaagttgtaagaggccttagattttaggttatttaatgtcatttaattttgtattcaaccaatacttactgattgcctgttatgtcttaagcgctgccgcagaggctgcaaatgcagtagtgtcttgaacaaactagtgtaagatgaacaataagcatggcagaagcatagtagcaactaaattcatgaagtgatatcatagtgataagcactatgaagaaagcaacaggataaagagacagagtctggctctggagagggggctgctgaaatagtgtggtgatgcaggccatctgaggatagtaatgaaatttgggggatgtctatgggagtagatgctgttggatgaatctttggagtactcccaaatgattgttcattcatttacttactaaaatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaatttaggcccagggaggaaatgctttgtacaaaactcactgctggtggctgacgttggcaagactggaatacagcccttgacttctgctttatttctccttgccactgagccatacagagtctctgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcgtgggtaccaggggctttgttggaccttgattacggttaagtcaagaaaatggaccttgccaagtataactgccgcaaactagacagagaactgtatgagacttcttattggctcatagacttctctgtacacactctaaatgcatggtatgtaactactccatcacttgataggcattccaggtatgtaaactaaataagatacatggcaagaaaaattacctgctgaagacaaaacaacaaaaacaaaataatctgtatttttccaaactcaatattcaatattcaagggagtatgggtacttgtgtatatattttatacttgtctacttctctccagtaataagaatgatagaagttggctcagttgattagtcagaggctgttgaaccaagatgtagggtcgatccttctgtgtaacagtaattctctccagcgaaaagagctttataacaatatctttatatctatttacattcttaaacagtgcttctcccatttcttataatatttaattctcattgttaagagattgttaaggcagaatacttagtatcccattctatagatgagaaaattgacacccatgtagcttatggaattttgttcaaggtgctgtgaattccagctactctggaaattcactgcctcaatgaaactggtctaaatgttggttaatagcctctatttataggttgctgatagtaggaattatgaaagctggacctaaggcttcctaatgtgaggctttggataggattatctgctctgagctcttagccagaaggcccccatatttatcagtgtgcaacaatcttgttttgacagcgacaaaacccaagtagtgtcacatactcagcttaacaatttttcattggctatgtaagtaattatgttaattttatcatattcttattgttaagtgggacagaacaccagggagatgtgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcggggaatttttcaagctcaaccaaactatgtatttatgagaggctatgggaaatctgcatgctaaagattattaactgcattctgaataattgcctttatacagaataacggagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcctgtttgtgtacatttagtaaactttaaggattgtaccaaatcaaagtatcagttattatttttggtgtataaaggaatataaattacttttatgaagaattaagaaatgtatggatttggggtataataaggtttacacagaagaagagctttttcacaaaattcccaggaaagcagggggaaactcacttagaaatctagaagcccattttatattatgacattatccaattatcccagagtatcatatacacaattccttagataatccatttgttgaaaggacagatataaaatataggagaattaatggtgaagggaaaaaatagaaatacggtgcttcagtgtggtagttacattaaatgatcaaaggatgacaagttaattgaataaatgtcttagccccttgaaatttgtatagggaatttataaaactaacatttattatatagtcaggactgggttctcgctttgataatatgtgaactcatttaaacctcacaacactgcaatgtagacatttcagtctacaaaaaccaaaggccagaaaggtcaagaaaattgcctagcttttcgaacccagatcacctttttcctactgtttcactaattctcttactataatatggcagaccttctttgatgtctgagttaataaatcttcacatgacttatgttgtaaaggcaaaatctatcatttgacttgtctcggaaggaaaggaactcaattcttttctttctctctcaccatagtcttagtcttctctgatatgttcattatgcccatggcatgagggtctgacccacagtcctcagctcttaggccccttccccctgccccacatttttcaaggatcagaacacattcaaaagaagtgttttggaagacctagcatgtcacatgggttatgcattttaaagtaaaatattacctctccgggcattaaggtataaataaactaaatgttctataattgagattttcttttccgatttagtaaagctcagatcacaatcctaaccctagtgcttaagaataaaaaacagggcgtaatttactttgtgaagaatgtgatttttagctcatggcaaaattgaatagaacggcctaattgctgtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagaccagcctggccaacatggtgaaaccctgtctctgctaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatctgcgactcctataagagtattagatattaaagactcttgttatagcacaacattaattccaaagtgggttaaaataagttttttttcaagtgccaaatccaatcccaactagaatagattcttaagagtcatagaccaccaccatactgcctgctctctcaccattcataagtaattactctcttctctgcattcccatcattcattactcgtgcctcaatgatagcaatttgtcatgccctttgcctcgaatcagttgttaatagttgtgtccacctgtctcactgcattgagaacctttgagggcaaggatggcatctttatcttccatctcttcctctgtacctgccaggctgttgaacactttgttccattctttaggctttctgcaatattagagtaagtgaggaggcagctctgctctttagagaggcatataagaagtttgtttaaagagagtttataagaaaactgaggcaatagatgcaaaaagttatgctccaaaagattaacaaaaaaagttgaaattatttcactgaattttcagttctgtgtttcatagctgtcatcttcaggggtaggggggtgtgtcatgacatcaaaaaagtacagtttagagatttgatgctatctattaaattgtttcaaaacgtttcctatctatcaggaaaactttcatctgtaaaagaggaattttgattctaattgaaaaatcacagtcataggggtgggatgctgttaagcttgagattattattttcagtctgtttcaaaacacacattacatgcagatacaaatatagacttagattaagatatagacaaaggacattagaaagaccaagagaaatgttaataaaaagttcatgtctcacaggaaggcagagctgttggaaggttatctagtatagggtcattagaactaccaaggtaaaatgatatcttcacttgcaaagcaaacccaaaagtactgccatcatttgggaagcaatcttgatgaccagaatcaaggtagagaataagtttttattccataattaagttaggcaatagcagtattctgagttcagataatggcactggcatttcaagagaaattggctgagtcatagccctgctcctttactgtaccacattaccattctgttgggaacacctacacttgagctgtacttcccaacctttttcacatcccagttcatgtggaaaatgatggcattcattcagcacacggagtaagtggatgagatctctcctgtcctgttcctgaggcaaccgctcaggaactctggacacctctggtccttccgaatcctcccaaatatggtgcatccggaacccacttgaaacacactgtgtgttaacctgccagttgagaagttctagactggagaattgttttgcatggttaaatagaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatttatttgcatgtaacttgcagatagcaagcctgaatgtcttctttctatttgaaatacagtgtgtgtctaccgatatacagattccatataatgtgatgtagcagagagagtctccattggacagagaattaggagacctttattgtaactcccaatctgtcactagctgtgttctctatctataccttagtttcttgaatccagcagttggactagaatcatggttttcagatagtacaggttccatcccttcatgcccttcagccagaagtgattttgggctctttaatatgtgctttttttgataaattgtttccctgaagaaaggattatgggtgaatggccaagtaaaagaaggtgaaaattcctgggctagtgtaatctctaaagacttttcaagactgaatgtcttctaactctctctttttttctttttgttcttatctcaacaagacctaaactatctagatcatgagatgtcactccttatctttccaagagtctttcctgtttcacgatattgtttttgtacctaaaaaaggtaaagatgaatataagatcacattttaattttataaaatgaaaatgttgttaacatttccaaatggcagtaatcactttatagtcttctgaatcttcaattacttatgtaaatgaagactgtatatcttgattttaaatactcaaaattgaacacttacatatacctatgtaatatgtaaataatggtaatattcttattctttatcatctcattagtagttcacgtttatgttatctatatgcttcatttatattcatatgattcttcagctcttctgcctgtgagttacaagttatttatacaatatccaaagatagaaaaaaatactaccccattgtatctctgacttaaaaacgttgcatttgggggttttctgtacaaagttgatttgtgatttaattgttagtttcactgagtttttttgtttttagtcacaattgtattgccaacatttcagaaaaatttataagctgtgacttttagcaacagaatctgcttttttctgctactctacgtcctttcattttaaccatactttcattggagtagcctaaaacatttttttatggaaaaaagtcctcaaacagtgcctgttgcaaaatgaataaaatttggattcttcattcagctttggccaaaggccttccacagctcgttaccaattacttactgtgtgtcatgaactttgtagtccctgggcaaggatgcttactattgtggataccgtagatagagtgtacaataggaataggaagtataagaagtataaggacttcctatactttcccacaggtgttgattgcaaggacacttcttgataactaactgtgtgcaaatctgcttcagaatttgtttcctaggaaacacaacctcagactatggcttcatgggaggagagaggagtgattgcagtttagtcatagaggttgacataaaccactaaatcaagtacattgtgttcagtgtcataggggaagcataatacaatcctatgggagtggaagaagttacttacttttcttggaatacaacagaaaaagatttaggaaagatttttcagaagaggtgacatttgagtttcactttgaagaatgagtaggcattctctaagcaaagtagaatacaagatagtctgggctggtaaaagaatgttgcttattaaagatgtggcagaaagctcagtgtggcagctgggaggaggagtccatgggaccacgatggagctggatcagcagtccagtcacaaagcacgctactgatattgaaggttcataagctggaaggtgctcttttcttttaaatccccagctatcaatgctggcaaccctactagacaaaaaaataaataaataaataaataaaagaaaaaagaaaagaaagaaagaaaaagaaagagagagagagagaaagaaagaaagaaaaagaaaaaagtgatttgaataggcatatttagagacatccctctttcacttatttgcttaaagactttcttttttttcaaaaccgatttatttgtcaaccatttcatgtcatgggttcagatgaatccaatatttgtatgaagcgtgcatctttttgtctggctttaaaataatcatctataacacaaaaatatccctctatgatccttacaattttaccattagcaatttctagaattatcagtggaggtgcatagtaaaggtaatatagtccaggtttctagcaaatgaatgcccctttcaaacctctgataaggggttatccagttgtttttgtatatttctgataatgtaaacatgtatctttttctattgttgttaatactgatttatcacagattaatacaattacagagtttgaattaatcatttttcaaatgagaaaactgagatcgaaggaataaattatttacccaatgtcatacagcagattttgacaaagccagaaggataattcatattcttcacctagcaactttcctttttcatggccacataatgaattccttagctccctctctgcattattaggagtcaggtaactggggtaccagtcccacctctgcatctcatgctctccacaactcaggtccagcacatccattctcaaagtctgcctgctcacctgtggaatgagagtctggactaagggaactcccagccccctcctcctgacactgtgagtttttcctttctcgaaggctactggtaggccccactggagactgaaaggggaagattgcagtaaaaggcgcaggctgtcgaaggataacatgtccttctacatcattcactagcctaggatgccagtcaacttcattcttggaacctttattttccaatttgcgggcattttgcaataggctgattttaatcacattttatactttttttcctttgttgcagaaatgtttgtattacctgttctttgaatgcagcatctgtagaccacaaggtctttccataggaactaagcctgttatattgctgctagttttgagtaaatgagctgaatcttgcagccaagcctcagtgcaaacaaaaacattttctggccaaacattttctggttattcaactccattacagggctgactaaaaaaaaaaaaaaaaaagtaaaaacccacagaggagcaaaacacaagtcctgggaagacaatttccagccacattagctcacattgtcagggtagaaaagaaacaggccctcattcttcaaaccatcatcatctccaaactcttaccctgtgctcttctgctattttaatttcaccacttcaaaatgggaaaaacaaataggttaatagtttccatgcgtttagactgtgaccagaggcatacgaagcaatttcagaacctcaggcaaccacagctttgagggaaggatgatgatggatttaccaattcatcttgggatggattccagagttaagggagtcaggccagcactgtgctgccagagtgggatataaacaatattcattcgttcattctttttgtacacattcatctcaggcttatttctatttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtcaaaatggcaaattgcgatacatctaggcattagccaaggcacagaagtatgggagtttcacataggtttgaacaagagtgagtggtctgagatgttatgagaaccataaaggggggttggataccatgtaaagaataagctctttttacattgtgaagccattaagattttattatccagaaaggtacttgtatttgatcacatctgtgtttggaaagaaaactggaagtcattggagacaggggcaaggggagtattataagaagagagatacaaagaagccaaatcataggtcattgctataggttagacataaggacactagttacctacgtacagacacttcttgcttcatagccatttatatatcctcatggtaaaagagcagctacccctgaatttccacatcccattcagttctgcatctttctaataagatccacatcccgggtttattcctgattgtaaactcaatgagttaatccagatacctcagttgtaatatagcattttacatgtgaaacgtggttgtttgctaagagcatggaattaaagggcaggatggaaagttaacagccgatctttctgagacctgactcactaactggtgtctcttttaaggggtgctatatatttttaaagcttagaatatttttaaggccagataaatgtgtttcttaattcactttttcaaaccagctcccttctacattcaacatttctgtcaagagtttgcaaactctaaacttggagatggtgtgtaaatcaaagctttaaatgatcagaagcctaattgattatgctgagttctgatttgggttctgcatttagcatgctctgtctcagtcatctgacaggctattctgtaaaaagtaggggtcttagtgatcgcactatggtctaagtggtcacactatgtctttgataatgaatcaagttttagaagtaatagtgaagcattcctcaatcggtgaaccagagtggtatagttcaagggtcaacaaactatgcccatgggtcaaatccagcccattgtctgttttttttttgtaaataaagtattactggaacacaagcatgcccatatgcttgcatgctatgactgctttccagctataatagcaaagttgacttgttacaacaaagccagaaatatttactatatgggactttagagaaaagtttgccatcacccatgctgtaggaaacaagggaaggaacaaggatagcagtcagaaaacacatgtcctcagttctggacttgccacctactacctgagtaatactagaaaagccacttgacccatctaattgtgtttccttctctctataacacacttctttggccagtttgttagttaattggccgataacacttgttttctatttgtaaggactgtattaaagctgtagatgtggtttgtaaatggtgataaatgccttccttagagtggtgtgataaggacctgagacaatctgttttgtaaagatgcctgtcatgcagtatggacccccttctgtcccagtctgacgtggtttctgtttccttccccagaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagtaggcaacctactctctcgtcaccaccctgccagtccttttggagtctgttcttactgcttggcatctgggcatacattcttctctctcagaactacagaatttcaggatttagtgaggcttttaaaagagcttattgatcccctcctccaatgcaagaattaatatcagacaatccatgcagtcatccagcctggtctctgtgtcaaggcttccccagagcttgtccattgcatctctgggtaattctaatgacgaaaaagctggctcagctatagtgtgtatgtgttagaaagaaacaggatcctggcctaaatatgaacaaaatttgtgacatttggcattgttcaacttatttgagctcttcagtttggtctttagatcaaaccctctctaaagctctctcagctgtgatgacccagagttttctcaagagctaatctgtgcatccctgccactctactgatagggagttatggtggacagacacagagaaccattcagtttcttttactaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcatttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggctggagtgcagtagtgcaatctcagctcactgcaacctctgcctcctgactcaagcaattctcctacttcagcctcccaaggagctgagactacaggcatgcaccaccatgcccagctaatgtttgtatttttagtagagatggggtttcgccatgttggccaggctggtctcaaactcctgtcctcaagtgacccacctgcctcagcctcccaaagagctggtattacaggcatgaaccactgtgcccagccaacgtttggtttatatttttaagaactgtactaaacctatagatatgatctgtaaatggtggactcaggtttctgtatgtgtttgctgggcagtggctttgaagacagcctttgaggctatcaaagagatgaagcttgtattgctcaccaggttgggtatccattctatggcttccaagtgtgaagtcttctgggttaattctcaccactgtgttgattgtcaacagccaggaagcacttaccccaaggagtttggagatctgagactcatattttaagaatgaatgtcctaaccactttccaagtagcaaagaaagtgaaaacctcaccaaaagacgtgaggttgaatgaattaaaaaatcccagaggcggaaatttgcaacctgaattagacaaggaaggactcacttttaaagggcagtcacagcataaattgtgcttcacattattgatatttttagcttgtaattacacattgaaaaatccctgcgtcttaagggaagtgaaaagatctcaatggggagtatgttctgttactgtttctctcctttcttagacttatcctaatccaagaaagactgatacttataatcggagcacacatgtttctgtggctagaaaagactgatacattacacccctcaattaaaacaggaaatcaattttgacaaatgccaatttatatctatgccatttatctttcatgtctaggggtagggagcataattagagactggtgactgatgacatcagtttgtgggtctgaaagctcccaaaaagcagacttgagcaactaaaagggggaaaaaaattaaaacccccagataaccttccccactcgttcaatgcatgttaaaacataaattaaaaatgataataatgttgtcttcatgattggcaggtatgtagggagagaagttttttgatcctttctccatttcctaaaggaaaataagaaactgttttatggaactcttatttataagccttaaaattactagaatacaaagcagctaaaagtccagcataggctaatcactgaaagaccaaagagagggcagacaaagggatattcctcctccagacagtttttggggccttgtttgtggtccttttgaatgggtctccttttgtggacctttagaaaatgcatgttaattcagttcaactcacatttataaagaaccctctgtgtgccaattgttgcattaaatgctgaaggagagagatacaaggagagaaattgtgcagatatatatagagaagtcactgtcagcaaggagcttgccaggaggagggcagagaaagtgtgcagacagggagaaagggctgaactccatgagacaggcacaggtaagggcttgcactgtcaaagtcagatcacctggctctgtggtcagaataggctttgtggacggagaatgtcaagagtgttttaagtgggaaacaaggagattcctggcagagggaacaactcaggcaaaaagcagaggcacagagttagtaaagggttctctgtgttcagggagatttgctttgctgtaactagagcagcctgggagtagagattaccttgagatacaggagacccataagaagggatttacctcacctgcttagcctgccttttatttatttatttgtttattttatttatttattttgagatggagtctcactcttgtcacccaggctggaatgcagtggcacaatctcagctcactgcaacctctgcctcccatgttcaagcaattctcctgcctcagcctcccaagtagcttggattacgggcacccaccaccatgcctggctaatttttatatttttagtacagacaaggtttcaccatgttggccaggctggtcttgaactcttgacctcaggtgatccacccgcctaggcctcccaaagtgctgggattacaggcgtgagccactgcacccagccttagtctgcgttttaaaccagtgcttcccaaactttaatgtgcctgtaatccacagagggatcttgttaaactttggattttaattcaggtctggagtggggcctaagattctggatttctgtcaagctcccaggtgcccatggcctgcactttgtgtaacaaggttctggaatactgtttttgagaacttgttaatggaccatcctctacataaacacctttggtcaatgttgactcatatcctccagcctactggacatgcaatctttcacatatgtcatttcagatgaccgctgcaaccactgcagtcttctggaagactatctcccctaccctaacacacacgtacacattttctcatttcacctaaatggttatctttaaaggcccaactcaattaccgtttcctggaagaaaacttctctgatctccacccctcccttttctcaagtttagatttacatcttaatctctgtgttttatagagttttataagtctgctgtagatagcacttaccacagtctgactggtatagaaatatacatatgtgtgtgtgtgtatatacatatgtgtgtttgtgtatatatatatataactttacaataatcatcttgtatcatttttgcaataaggatttgtatatataaattaatagaaatactgcagaaatatatagaactccttctcaggtctgtactggaagtcgttgcttattcttgtattcccagtgagaaaacccagaaaagcagatttctttaactgactctttgcatgtatggaggctttattcccctatctgtgctttcttatcaggaatattaccctcattcatttatgtatttaatcagcatccattagttgattgccagaaatgtgccggaatacaagatgaccaagatcatccctctctgagccttcgctctgttggctgtaaagtagaaatgataaaaatacttcctcataatgttgctgtcagtagaaaattacgtcaagtgtgtacagcacttaacagggcttggcacataataagcactcaataaatggtagctttaatcatcgaaagttgttttcatcaaatttacttttacgattattgtccactcagtgagctaagccttgaaatagaccacctgggattgtgagccctcctcgaattgctatcggaggaacactgtggggactatgagaaccacctcctgcctcttcgctttggtttttctcattatggaaatgaggccaattggtaggaaagaatcattactcagcaagaatacagtttatgtcttcccaaagaggaagaaccttgagattgaacataaagcccaactaatatctttttttatacagaaatatggcagattcatttcattagatacagcccaactttttttttctgcaccagtcacagtggttgttcctggagactcagagatggagcaaagtcctatcttgtggaaacttagagtttagtgccccataaatatatccaaataattactaccaaaatggataaattcaatgacagaattcttatcttagaggagtaaataattctatttggggaaattggagaaggcttatggatacactgaaaaggaaaacatacttctgctcccacagagtttggggaaaggaaattttgcagttgatcccagaagcctacttatttcaccactgatgacccagatttaaaaataatctggtagtccaaagcaattttttgccactgaatataaacttcttgcataaaataccaattataacaactctgattactgctgcagtggtaccatgatccttctaacttttctttcacagcaatcaattgatctgctgcttaattcatatttatttagattgcagccatacagatgctttttgggtgctgccaggaaaattaattacctacatatagaatataatgtatgtagaaatgctttgacaaccgtaacgtgctctgcaaagagttagattattatcattatttctttttaagtctcactacaaatagataaatttttaacatcgtttatcttaaaaccagtaccatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagtattaaaagtatttaccagcagcctcaaaaacatatgcatatgcatatttatatgtatatgtatgtgtatgtgtgttagtatacactcaccctttaacagtgctaaaatcctttaaagaataaagaatttgatagctctttaacttttaatttttaagcaaaagtttaacacaataaaaaatgtaggaaatgcagacttggccacttttaagttttgtgtaatgtatatttaaacgcactaacctctgcccttttgaaaagctatgtatttgagtcttcttatgtcagttcctagaagtcaaggcaaatttccaagaaagaagctctaaaaggtgggaacaaggcaaagataccaacctcagactatttttctaggacctaaggagtgcatacaaaagtctagaaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccacctcttccttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagtgcctgtactcataggacttgggttttagatttgacactagtattccgagcacatgctgttgaataagtcactgtacctctctcagtctgcttgctcaccggaagaaaggactcaagtccttaactcctccaaatatggctgtgagagtgaaatacaaaattgtatattaaaggacattgtaaattgtgaaatactaaattagtgagaaatggtgttattgaacatttaactttggctctgaggctttggttagaacttcttgttcagagtcatggagatttatttatttgttagcatgcactactaattgctcagtttcctgaacgcctctagagctgcagtatatctgcatgttcttttcagtaaagccaaacttcccgcagagtataaccattgctgctattgtgttctggataccccgttaacttaaatttcattctatgtcaaatgaagacatgaactccattgacctccttgccaccatggtagatagcagaggcgaggttcatagctgttgtggcctttgagagtttatactaaagttagcaaacacacacctcttgatgaagtactatgtatttattttccaaagaaacttctattttctccaaagacaaaggccagcatttaactgttatataacacttttcaaaatggaccctaagaggagctgtcagcggtagtatattcctttacagttatgcagttctttgcatttttttttttgatccattatcttctttgatcctcttaacagcttggtaaggtagaaaaggcagaagttattttcagagtggcagtcggcctgtgtgcattgaggcagactgtagcaaaactgtgggtggtgctcaggaggcctgtcccctggactagcaatctttgctctccacaatgctgtctcctttagaaagtacagcaaaccactactccccacaaactttaggattttattttcttactgcagttgaagtaaatacaccgaacccactggtggcccttctgcttggcagacatcagtctacctttgctctaggccagaaatggccaaaacattccattcctgtacctgtgcatgcattttgagagatccttaaactaatggtaaagggtaaaaaatgcatcggtggttagggacattcttattttctcttgttgagtgggggcagcaaacttctacatgggagccaagatgggtggcctcttctcttcttatacctgtatttcatatcaagtgagcttaggaggattatatttatgtccatttatatttatgtccccaatctctaattcaattacattcaagatatactatgttatatattgggagaaaggatacaggggattagcagaatgtaaagcaggaaggatagtaagtggccacattatggaggccttgaatagaaagctcaatcatgatgttctccacatgtgtacttaacgtttttacttatgtcgtttccatctgtctttactgttctaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 2489 - DNA, 2267 bp, Homo sapiens
cttgtttggaattaaacttctagcaatcatttacctttatggttctcttaacttcaggtcacactgttgtttagtcaatgtgagaatctttcagatgttctgcactttgcaaaaggatattcacagccaatgtgtgcggcagtgaaggacacttgttgattccttatttattgtctgctgttccagggaccggggactagaggtgaataaagccttgtttgggctgtctaggatgttgtgatcgacacaggaaacagacatgaaagccaaattggcgcagtgggtgaagtattgtaatactggtctctgtttatgatatatggaagaagtttcctagtagcagggtgggtgagagagtccatcatcattgcagattggtgcctctgtggacatgcaggtatattaggccagaggtggggagtgggagagagagggagagagagagcacgacaaagagagagagagagagtgagcaagagagagggagggagagagacagagagagagagagagagagagagagagtgagcaagagagagggagggagagagacagagagagagagagagagagaggttttgagagcattgatatggggtctacatattccccccggcccccattccctattatcatagaagcatgctgccctccaaggcttttgaatttgccaccgtgaagagcatgcatggaatcttcggctgtggccttgcattgccccctgtcttcgcagcggagcttctttatctgacccgtgcatgtgcctctgatgagcagcccttcatcacagctctgcggcctcctcctaggcccccgccttcagctctccagttcatttcccgccttgttcccattgccacctgcgggcttggagggccacctgacattctgtcctttgggtcccctgtgactccagagctccttcccttctggggcgcccacatctgcgacacgcttgtttgcccagtgcattttctacacttagagttcctctcgtgctctcatatttccatttaaagccctctcgagaggtctgtctcctgccagcagcattccttctagtttactagaactccatttctcatcctgccaggaatccagccgtggagtgagcttcagcaagcctctctgcagtctcttgtctgctccaaaactgtggcctctggttgtgagaaatgggcatcctgagtcagtgagagcagtagttagcttgcagcagcttcccctctccccctgagtgagcctttcttcctcttcctcctctttcattcagcctcatcctgccttgggtccatttgacagataatggcaccttgaggccttgtcttttgcatggcatctgtgcctgactggtcagaaattacttgtgaagcaacatagggggttgttggttgggtccacttttaggatgaagtcagaagggatcgtgagtgatgcttggccaataagaatgtattgatttgatttactaattaatttcatttccagacaccaatatatgcatagccttgtttgaagaaaattaaggagaaccattttgtaaatggcaatgagtgtaagacacttaactatcttcctgctctccctggcgtgggcttccgcgctccctgactctgcttttatttaaggtgtctgggaaggcatttgtccttcggcttcccagctggcttcttgccttctcactcactgcctcccgtagcctgtgggcagaatccctcaccgtgcccaccttgccctgctctcgtctgacctcacctctgtttccaggatttgctatggctgtcccctgccagtcatgctctgtgcttgctactctgagtgtgtccctggtcccactctcttgcagcctctgtgtcttagcacatgctgccctgatggcccaagggcccttcccctttgtttctgtctggggaatgttctgtctcctctttcttgaacctccttatattccctcaagaagacttaaggcaaaaacaaacctgaacttactatgtgtggtatttttgtgttataagtgtaggacctagtcatagtaacacatttcaaaaatatggaaccgtataaagaaaatgagcatcactcataaatcactatttagacacaagcattgtttacgtttctaatattctttctttagtggtgcttttcatgattttatgtgcatttgcattttactgactaaatattactatataaacattttcatatcttgccacttcacctaacaatacagcacaagcagcttctcatggcattaagaattgttt

SEQ ID NO: 2490 - DNA, 7253 bp, Homo sapiens
ctcccaggccctctagggggatggtcaggcttctgcagagatggggaggatcctttcctggtaaggggagagggacgggctaggagccaagcggaaggaccccgtgttcaaggcccttcaagggacgggacaggcgaggaatctctttgagtcttttgaattgttttatcagtcaggcctgggaagtactccgcctccacaaactctgttttcctgaaaggggtcgggggggggaccccaacatctcctgccacaggctatgatgggcatggtggctaagagcaacaggccgcgtggtgaggctggctttttgtggctctgccctgccattccccgaggcatccccatgccagtgaacagagctgcgggttcccagctgcacagatgaatgcacgaacaaaacataggtccatacaaaggaagtcattgcattgatccagattcgacctgggattgtcgcataaaacagggctgataaaaaccgtcgtgttttcaccctggaaacagagactcagcctccccctctttgcttgaggcattcagcaaaggtttgtccttgagtggctgtggatgctcaaggacttacgatttctgactttataaagtttagggtgaaaacaaaaaacaaaataaggagaccattgttttaaagtggccgttgtagctaattatctcaagaaagcaaacaggctggtactgaaagttacacaggcgggcggctccctgggagggttgcccagctctccttttctgagacctgagcagggagcagccagaggagcttgaagggatggtgttcagggcatgggaacaggctgcacacatcttcacggagtacggtgcttgtccagtttgagaagggaaagaaacgggagcagagggctgatgagaaggcagcagatggatagtgcgggattgaaaaggggatccatttgaagactggccaccattatttattttcatcatctgattgctgttgctccattgagatcgatgcgtggagaacaagttggggagtggaacaaatggcagggaggggagagaagtgagtgaacatgaccctggtccagcctcataggacagagcgtggtcatgaagtccacagaggaggacaggtagggaggaatcatggcatggccaggttgtagggcaagaggcagagaggagagaggattgtggaggatgcctgcggagtgccgactgtcagtcgaggctggtcctttatttatttattttttttttttgagacggagtctcgctcttgcccaggctggagtgcagtggcgcgatctcggctcactgcaagctccgcctcccgggttcatgccattctctcgcctcagcctcccaagtactgggactacaggtgcccgctaccatgcctggctaatttttttgtttttaatagagacagggtttcacgtgttagccaggatggtcttgatctcctgaactcatgatccgcccacctcggcctcccaaagtgctgggattgcaggcatcagccactgtgcctggccaaggctggtcctttcttttatggcgatgggtgtttgaaagttgcacataccaaaataaactcactatttgttgacccaaagtaaaaccctgagggtatgaaagggaagggctcatgcttacatggctgagataaaagctgtctcaggaagctgggtgtggtggctcacccctgtaatcccagcactttgggaggccaaggttggaggatcccctgaggccaggaattgaagactagcctgagtgatatagcaagaccccatctatatttttaaaaagggttggctgtctcgggacttttcgaaatagccctgcaagacattcctgttttggaatcacaacaatttagataagatgcttttgaaagaacacctgcctaggcacagcgtctccaccaatgaactgatgccaactgtggttttgagtcttcataaccggtgaactgtttgcaagcagcttatttaaatctctttttttgccaatacaaccttccctttgccctcccctcttgagatgcatatatggcttgccatagctgagcatcttaggttataatgctttttctcttttttaatttttttttgtaaatttatatttatttttatatttatttattttttgagacagggtcttgctttgtcacccaggctggagtgtagtgcataatcgtagttcaccactgcctccaactctcgggctcaagcagtcctcccacctcagcctcctgagtagctaagacaacaggcatgcaccaccatgcccagctaatttatgtatttactttattaaaaattttttttttttggtagagagagtctcactgtgtttcccaggctgggcttgaactccaggcctcaagtgttgctcccaactcgacttcccaaagtgctgggattacaggcatgagccaccatgcccagcgtataattttgtattctaattcctgaataaattcaacaaatttggaggtgttttttgtctgatggttccttttggtcgacaactggaatgggagaggaacagtgtgagggcaaacatcaagtgctttgctgagctccgggtgctttttttggataagacacagaaaatacaataagatgtctgtaatgtttgatttttttccaggtttcttgaggtataattgacaaataaaaattgtatggattcaaggtgtacaattcatatacattgatccacatataccttgtttgatgattaatcaaattagttaacacatctttcaccccagcagtcaatgtgtgtgtgctctgttagcaaatttcaattaataatatagcattattaactatagttactatgctgtatattagagtctcaggatttaccatcttataactaaaattttgtagcctttgaccaacatctctcattcctcccacccacagcccctgggaactaccattctactctgcctctatgagttccactttttgtgtttcttttttccctttcctttaattttttttgtatttgttatattaccaaaccatgtcaaaagagttccactttttagattccacatattattagctcgtacagtatttgtctttctgcatctggcttatttcacttaacataatttcctccaggttcattcgtattgttgcaaatggcaagattcccttcttttttatgactgatgatgtctgtctgcaatatttgaaaaaaaaatgcagatcacgtgaatgattgtctaatgtaattctattcatgtaaaattgtgtatgaccataacagtcactcattcattgcttcgagttctttacaatcggatgccatattcctggggctctgctaggcctgaaatggggagtaggagttacaaggttcctgggatatcagtaattcatatttgtgaatgtcttagataagtgggctaacatgtacagaaaatggtcactaaaatgataacactgtttgttataaaatacttttctgtattctcttgaactttttttttttatcatttattagactgcttcagctgccataacaaaatatcacagactggatggattaaacaacaaaaatttatttctcacagttctggaggctgggaagtccaagatcaaggtgtcagcaaggtgggtgtcattctgaggcatcttctcttagcttataggctgaggccattttgcgttgtgctcacgtgacccctttgtgcgcatgtgtggagagagagcatgggtgcttcttcttataaggatgctgaaagttatgagaacccgacccttgtgacttcacttaatcttaattacttccttagaggccccatctccatatacagccacaatggggattagggcttcaacatatgaatttgtggtggggggacgcaaacactcagttcataaacatatgatttttttttccttgatcggcaatgaaaatagaggtatcttcattttggaaagtgagagtcaacctgtgctgaattagagtgatgacaagagatactttaagactgcaatgagggaagcaagggatggggacgcatttgacagtctgttctgctgtgctcctggaagtgagagaggctgagtcgggactaacctttgcacggatgagatagagaactgagagagaaaagtatgtatttttctatgaccacctaaaataaacctggagttgaagggaccagcactctcaacctaaccattctgggaataaaaatcatagagacctcgctgattaatggaaacaatttgcctttcgattttctaagcaggtgaatgcaaggagtttgtgaactttactgctgttttcgtgtttttttaggtgaagacactgacagtaagaaaaggcaaaccacaggtccaagacaaagtggtcaagtcaagaaggaactcaggctgtgtagtcctggtgcaaggctccttgcccccagcgtggggtcacactggctggctgtgctcccacgacacttagtgcatactgggctcctgacttaataacacgtgtttgaaatggcccctgattcccaatctgctgcaggattctgcagatgcgcaacaggccacagtggaaggtcttggagagaattcagagtggcttgcctacgttcccatgaccgtttgtcctaatgggagaatcaccattttggaaaattcttttggaggccaggcgcggtggctcatgcctgtaatttcagcactttgggaggctgaggcaggcagatcacctgaggtcagaagttcgagaccagcctgggcaacatagtgaaaccccatctctactaaaaatacaaaacttagcctggcatggtggtgcacacctgtagtcccagctacccgggaggctgaggcaagagaatcgcttgaacctgggaggcagagattgcagtgagccaagattgcaccactgcactccagtctgggcaacagagtgagactctgtcttaaaaaaaaattcttttggggctagctgtgaatgagctcagagggaaaggcaggagccttcaggtagggagcagcatgattccaccccagattcaggcctcctgggtgtacagagggcaggaggatcctccccaggtatgtgagaggaagggaagatgaggtgtttgggtcagtgaacacactagaaatccaggtgctcactgatggattgtgcttggcatctctgttctgccaatccagcctcaaagcaactttggaagaggatttatgcgcttcacacgcttccagcttgggccagagcatctgcacactcccctgggtataggcctccagggcttggagcaacggaagagctaagaattgtcagtgctcaggaggcagattttcagggaggatcctcttgcatctcaggacatggaaagggctaacagagccttaagtgtcctgtcccagtgctggggtctcagaaggcagctctggggcatctccaccatggtctgacttctgctgcttgaaaccattctccctcacggcacaggcaagagtcctcaaggaagagcacctgggcacctgggttgactcttcctctctccaggtggagagaaccagtagagtttacctggggtcatgctctgagttaatccccctctgcatttctttctcttctcaggggcctgggctcagccttgactcagccttcctcagtgtctgggacttggggtaaacagtcaccatcttctgcactggaagcagcagtgacattgagggttctaaccatatctcttcgtacctacagtgcccaggaactggccccacactcctcatttattatgtccattctcaacccttagggggtcccagcttgattttcagtctctaggtctggcaacacggccttcctggccgtctttggcctctagcctgaagatgggcctgacagtcactgtttgttctgggacaaccatagcatttttacccacatgtgctccaagtccacggggaacagagaccaaatctgccatgagtgaccagtgtcacagggcttcacaccagtcaggcagtcagatggtggtgtttgctttcatttctgctcatcatcccaagggggtggacgcttcaggaatgggaccctatgcaactctcattgctctttataatgatgtgggaaagagaaaccatctcccaggggacttggctttgcaaaaatgaaaataaaagctccctcctccctctgtgcagtgaatggcctctgaatgcagacttggtctccctcttcagtggcaaggttggaggaagaacaacagcttcttattgcactgagacaactcaggggccacctcatttgaagatgtgcatcagtgtgagcccaggtattcctgtactcaatgatcgaggtctctctccttaccttgtctccacctggatctgaccaaagtgactgagatgatccaggttctagttttctcttgctgtgtaacaaatttctgcaaacctagcaccttaaaataacacccatttatgatctcccagttttcctggatcaggagtctgggatcagcttagctgagtcatctgttcagggtcttcccaacctgaaatcagggcattagcttggctgtgttttcatctggaggctcaactgaggaagattctgtttccaaacttactggcagaactcacttccttgctgctatatgactgaagccaaggttttggggggctatttgccgtcagtgcccgaagctcctagagttcctagaggtcacccatagctcttttgccatttaatgtaacctaatgaaaagagagatattccatcacctttgccatatttattggttagaagcaaatcacaggttcttcttgaattcaagtgaagagattgtgcaagggtatgactcatttggggtcaccatagggtacatcctcagtaattgtgtgcagtcaggactaggggaggagattctaattatacagagaagacttgtgccttctattcagaagttaagaagacatcctttactttttaagacactctgtcattttattcattgatttttagtggtgttctagaaagcagattttccaagcgtaaagcacaataatgaaatggcagagctgatgacagttcagatgctattagatgggtgtgcagatctaggtttagagccaagggatggagtagtgtctcttggtctccactgtggagaggccccttgggaaaacccaccacccccatttctcctcactccctgcctggacccatggtctctgcttggtctggcctatgctattaaaaatatacttcaatgatga

SEQ ID NO: 2491 - DNA, 728 bp, Homo sapiens
ggagtcagagctctgcatgtctgcaccatgtcctgggctcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctg

SEQ ID NO: 2492 - DNA, 24863 bp, Homo sapiens
cgcacagcggcggcgcaggcgcggagaggggcacagcggcggcgcaggcgcggagaggcgcacagcgcggcacagcgaggcgccggcccagactccactccccagctgtgaaagggtaagaactgagggtggctgagactcggggttgttcagggcggggtgggctctggacccagcaggcccggcacccaggtcagggctccaggggaggccaggtgggcgaaggccaagaaggggccggggctggtcaggaagggctcctggtaaccagagcactttgcgtgagccagcgtgggaggaaggtgggctggatgagctagggaggcgccgggaggggccttggcagaggcgaccccctccgtcagcccccaggccactgaaccctgggtagcgagaaccgacaggggaggctgcatacagaggagtggaggctccccggctttgggggctctgagtagaagcatctagggggtccctcaagaggcccccaaacgcctccccatggtgagaaaagaaagcgcagagaggggcacggctgtgatttcttttattgccccaaatgtacttcatcttggtagatttctattggctttaaaaatgtgtgtgttttgctgttggggagtggggtgttatacggatgtcagattttgctggttgactgttcagatcttttgtaaatccttgctccttttctgcctagtttcactctgtcacttacattagagtgcggtggcacgaacatgactcactgcagccttgacttcctagggtcaagtacttcccctggcttaacctcctgagtagctggtactataggtgtgtgccgccacacctggctaaatttaaaattttttggagagatgaggccttgctatgttgcccaggctcgaactcctggcctcgagctatcctttgtctttgcctcccagagttctgggattacaggcatgagccactgtgcccggcctctgcctagttttaacagttgctaagaggaggatgttgaagtagatgtcttcttggtgggttaatccttttgtcattaagcagttgttatggtcacttccttttcaccccattggtgaaggaggggtccctgccctaaagtgtaggagatggctgaacacgacacctggcgtggatggatgagattgacagcagtgttttagtcacatatacccacagctcagaggaggacactgcatgccacacagggtcagatgggcaccgcactctgtagcggagtgagggctgtgggctgaggaagcaggcaggcttgatagtaacaagagcacacaatgaccaatggttcccgagggggaatgcagttggcttgtttgaataaattcatgggctggcagacaggtgaagtgaagcttcttaggctgaggtgcaactgtttggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcagcgaagaccctctccagctctggtaaattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttatagttacataattgcttatgtctgatgtttttattatttgctttttcgtttcctttttctttccctccatcttgatctatttctgtataatgttgttgctcgtatctctttgtatagtcttaaagtgtttgctctggatgttacaatatgtgtattgtaatacagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctggtctttcctttgtccctcctcctatagtcccatattcatcccttctgcataagaactttctgtagccatttttttgttttgatttttttgttttaattttttgtattgtggaaatgacagaacatatttctgtagccactttttagcatttctaaattgaccagtgacaaattcctatattctcttcctctgagaatgtctttatttctctcttcatttctgaagggtagtttcatgggatatagaatttgcagcgaacagtttttttgtttggttggtttttttgtttggttgttttttttttaaacacttgaaaatgttgtgccacttccttctggcctccatggcatttgagttggcgtgtccctacaggcattctgccatttttggtctttgtttttagttttgaaagtttaattggtgttgctttcttttggtatactttgaggtttgctcagcttcttgaatctgtaagtttatatctttcaccaaatgtgggaagcctcaggaattagttatttgcatgctttcacagctctggtctcctatgggactcagataacataaatgcggggttatcgtcccacaggtccgtgcagctctgttcatttgttttcaggttattttctctctcttgtttagactgggtgaattctgttgatcaggtttcagcttctctgattctctcctctgtcgtctccacttttactcaatagggcccatccagttagtttttttaaaatttctgttactggattttatatttctgtaatttccatttgattcttcagtttctttgctgatgttttcagttctttgattgttgccataggatttgtagttgcttgttgaagcatttttatactgactgttataagtgatgagtcagatggttccaacatctgcctatgtaatttttttatttttgcaggcagtcctcctgtttaggtttagtctgtaggtcttggtctactttgtgggctgtgattccaatggcaatttaatttcagagccttcatggtgttattttggtctctttggcttatatgtatcactgggattctcccaccagtccctgttgttgcccacctgagggaacaggggagccgccctaggctgggccacctgctgcagctaggtgggtggggaatggtggttgtcttggtgtgtggagctggttttcttgttgtggggaagatctcctttgatctgcggggactgagtctgcctgggttgccttctattgctacgttgggagttgggaaactctgggcctgggtcaccttcctattggatgaggtccagggagacacctggccactatgcattccctagtcctagagtccctcagcagcctttttctgtccaccttttggaattctccattgatcctctcctgtctattatttctagagtttgggttacatttcttaggagggtataatgtgttatcttctctagaccagaaatccttagtggtggtttcgggttgtaactgtgctaaagggagaattggcgtatttgtgatgtcgggtctttcttttcaaatgaggacatatcattattcagtatataatatttacaacacctacttccttgggttgaagaatgtggttaaggcaaggaaagtacttaacacagtgcctggtgtggagagcacttacgagtgttggtagtgatgctattccttttgtcctttggtagcctattaaagcttttcttcttttttaaaaaaataaagttccggtgcacttcttgttaggtttattcctattttatccttttttgcttttattgcaaataggagcttcctatcttttataacgtctacctggttctttggcccttacgtgaaaatgttttaatagccttctaaacattgttctctcaaatgagttttaatttgcctctttcttttgttttcctttttttgagacagggtctcactctgtcacccaggctggagttcagtgacgcaattatggctcactgcaacctctgcctcctgggcccccaaagtgctgggtttacaggtgtgggccactgcacccagccttacttgtctgtttcttttaagagtgggaactataattgagcccagagctccaaaaacaaatgaagaaatgaatgagtgaataagctcttcccatgggtttggtgtggtttgggactctactcttaatctaaatgctatgttttatataatctaaaatttcccctaggtgtgttacacgattgtgttgtgttgaacttacattgagactccttttcacatgtgctggttatcagcgtgggacttttccattcactctttgaattattcgtttgggggacacagatagacctctgtgtctttcataaagagtgtccattggccggttgcagtgtctcatgcctgtaatcccagcactttgggaggctgaggagggcagatcacgaggtcaggagttcgagaccagcctggccaatatggtgaaatcccatctctactaaaaatacaaaaattagccaggcctggtggcgggtgcctataatcccagctgctcgggagactgaggcagtagaattgcttgaacctgggaggcagaggttgcagtgagctgagatcgtgccactgcactccagcttgagtgacagagtgagactccgtctccaaaaaaaaaaaaaacaaaaacaaaagagtgtccattatctatactagaaaaattgagattgggattttgacatgaagtgcggaaatgtggattgggtccatttagtttacctaaacagatgatgaaatactaactgttttacgaagcattccctagtgcaaagttttgcctgtgtttctagtgatgggaacagtgagaatcagacttggaacacggagcgcattgtgggcctgtcgtgggtggggccagcagcacatgcatgccgggctgacagagcagcctttgggtgttcttttcccagaggagctctacggtgactttgaagacttggaaacaggggacgtgcacaagggaaaatcgggccccgatactcaggtatgactttgtcgtagctggctgttcttggtcattgtgttctgagagaggcccgcattgagaaatgcaaatcttacttgtgatgtgtgaagattgcagactggatggatagattccttcctaaagtgtggggatgtggggaccaaagagaagctttcttatttacttgttaagttttggactacagttactaccgtttcttgccatagtcatttgccaagtccactgtgatttttcactcacagaagtcttagcttctcagacttacattcaaccattgccatcattctcctctttttaaatttaagtgtcatttaaaagaatgaaatccctgttctccctaatatttctttagaacagggtctgggagcatctgggtgagggacatgtctgttatttttattctagtttgtgttcccagccagcttaaggaatagcagctagttgtaatgcagatgtaacaatttcctgtagcagtaccatgttattcagagacaaaggttatgttgtgttttgttttgttttattgataatgataacagatttttgctaagatttttgtttaaatagaactttaaaaaatctaatgtttaaagaaaagaccttcataaacatacacaaaattttttcttctggaaatttaagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtgagaaacctcagttcctctcagccccttgtcaagactatcacatagtgtaggaatccctgactttctttgggtccctgcttcctatcctgcttctgtgcctttcacttggactcctgggtagatgcatgtgagtgtgtttattcatgcagtgagctcattgtttctacagtcagaaggtcaccagaaaaagatccatacctattttgtaacaagaattaggaaaccgaaatgactgagacatggtctctacttttgagacttttacaatgtagcgatctgagatagtgtgttcatttcagtgcaagccaatgctgcctattccgatcgctgctccctgatttgaatggcaggtgatcagtggcccgtgtggcttatggacacaccagagctcccaggggaagtgctctgaaaacatcctggtcagagttcagaaggacatgtggagtataaggtcagatgcggagataagggagatggtgtggccctcctgcccaggggtgctgagcaggttgctggaggcggtgatctcactctgaaggagacagacacagaaacgtatgtacagttgatggtgagcatctgagttgcgtcttgttagtgaggccaggagtgcctgtgtaagctggaacagattaggtatatgatttgtgaaacggagtttcatcctacgtcttcatctagtcaaaggactgtttcctgattaggcattagcttagtggttgctagtctgtgttgacctttgaaaggcatgactaggctaactctgaagttgttgcttcacaccatttacaatttaaaattacctagagccttgtgggccattggaaaagactgaatgtttcactctgaaatgggagtccttggagggttttgaccagagaagagacattcaggtaatcagatcactctgccaagagatcagtccagtggcacaaaccagagggctggcagtggagatgagacagagtcaaacccggattgagtttatttggaagctgggtcagtaggatttcctggtggactgaatgtggggtgtgtaagaggaaatgagggtggcgactggaagttcctggaagggtgggttgttgcaggttagataggaaaccgtctgcagatgcagttttgggaagatgatgtttggttcggctgggtatcatgcagacaagcggagtgtcaagtctggagagacaggtctggccagggacttagatgtacagccctcagcatgtagatgccacttaactctgtgaggtggccggggagtgagtgcagagtgactgggaggagcaagactggcatgggcgagatggggcgattgcggccgtgaggcctgagcagtgcctaggagggagagggagaagcagtgtgagcatgcaggcacgcaggagtccagttgtacacggaggcgaagcactgttcagatcccgctgcagtgttaactacggtaaaggcagagttgaccactggaggagtccttcagcgtggaggccttcagcgatcttggcaagcaccaattttcgtggatgtaggagaatgggagcagaggaactggaggctgcaactgcggaaaacttttgtggggttttgctgcagagagaagcagagaaatgaagcagttgttggtggaagaaatggaatcaaaaggttttgagatagagaacagagggaagagctgttggaataaagtccaggaagagtggatggtgtctagtgagcaagtgatgtgtggccctgagtagaggcacgtacaaatcacctgtgcctgagctgcccttagaactttctgtgatcatggagatgcacgtctgtgcttcccaatattgtaacattggccgcaggttgatatggaccacttccagtgtgactagtgtgattgaggaactgcattttaaatattatgtaattgtaattaattttaatttaaatagccacacgtagctcctctataggccaggtcagagctctgataaggctggatatgggaggaaaccctggtagagggttgactgtagaggttcttttggttttggagtgaatcaggaaacagccatcagctgagtgaaggtgagggtggtggtgggtgtttgaagacaagggaaaagtgtgaaagaattgtttggagaggaaggaaagaagatgtggactggggatgtttccaatgttcgagcacgcagggctccacagttatctacatttgctgtcccttggagcaggagagaagaaaacggttgggacatattctgagcagactgtagaggtaaaatacgtagtttttttttgttttttgagatggaatctcgctctattgcccaggctggagtgcagtggcacgatcttgactcactgcaacctccatctcccaggttcaagcgattctctcacctctgcctcctgagtagttgggactacaggcacgcaccaccacacccagctgattttggtatttttagtagagccagggtttcaccatgttggcgaggctggtttcaaactcctgacctcatgtgatctgcccgccttggcctcccaaagtgctgggattacaggcatgagccactgtacctggccaaatatgtagtatttttaataggataaagcctacataattctgtccacagttcctttacttagaaattgctcatttgttcatgttaatgctatgtttattacagataacagcatacaggttttccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtcttaagtagtgttcagggcagggtgttaccattcatgcttgacttctagccagtgtgacgagaggctggagtcaggtctccggagagttgagcagctccagccttagatctcccagtcttatgcggtatgcccattcgccttgtgtctgcagccccctggccacacccagtaacagttctgtgatctatgagaatagttcccttagcgacctttcccttcaaatactttgcagccaggtagagaagtttggagtgaaggttttgttctttgtttcttcgcaatatggatatgaatcttcttttgaaaatattaaagtaaattacctcttttcagatattgtcttcatgcaaacttggtatcctgtttccatcccagccttctgtaacccagtaacatctttgttgaaaccagtgggtgagaaagacacctggtcaggaacgcggaccacgggccaactcaggcttgcccatggtgtcagactaaaggcaaacaaggactctctgtataaggtactggtcgtgtgtgtgttagtggagatgaagcctgtgctctacagacagggagtcacacagacacttttctataatttcttacgtactttgaatgttcaagtataaagtctaacattaaatttgattgaacaattgtatgtttgtgggatattttggagtggaacaccaaaaaatggtaatagtggttctttctggattgaagacaaacttttcttttttaaaataaattttattttatatatttgaggttgacaacatgatcttaaaggatacatatagatagtaaactggttactatagtgaagcagattaacatagctaccatctcacatagttagatttttgtttgtgtgacaggaacagctaaaatctacttatttaacaaaaatcccaaagacaatatatttttattaactatagccctcatgatgtacactagatctctaacttgttcatcctacatgtctgctactttgtattattttaatgtacatctccccatttcctattggtcatttcctatttggcccatttttcaactgggttgtttttctgctattaagttgtaagagttctttactgatttttggatattaacactttatcacatatgtggtttgcaaatatttcttccagtctgttggttcccctttcattttgttggttgttcctttgctgtgcagaggctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccaattttattcttttgcatgcgaaaatcctattattgaagagactatcttttttaccattgtgttgtcttgtttgcccttgtcaaaaattagttgacagtatatgtttggatttatttcaaaggtctctgttctgttccattggtctatttttttgtttttatgccagcaccatactgttttgattactatagctttgtaatacaattttaaatcaagaggtgtgatgcctccaactttttctttcacagtaatccgttggctgtttgggattttttgtggttccataagagtttcaggattgttttttcttttcttttttttttttttgaggcgaagtctcactctgtcgcccaagctggagtgcagtggcataatctcggctcacggaaacctctgcctcctggattcaagcaattcttctgcctcagcctcccaggtagctgggactacaggcacatgccactatgcccggccaatttttgtagttttagtagagacagggtttcactctgttggccgggctggtctccaactcctgacctcgtgatccacccgctgcggtctcccaaagtgctggaattacaggcgtgagccactgtgcctggccaggattgttttattcggttctgtgaagaatgccatcagaactttgatgaggattgtgttaaatctgtatatttgctttgggtagcatgaacattttaacaatattaattctcctgatccataaacacgggatgtcttttcattcgttcatgtctaaatttctttcatcaatgttttatggttttcaagtgtacacatctctcaccttcttggttaaatttattcctaagtttttgtttttctttgatgctatcgtaaatgagattattttcttgattgcttcgtcagctacgttatttgtatatagaaatgcaactgatttttatatgttgagtttataccttgcagcttaactgaattgatttagtagttctcacagttttttgtggaatctttggagtttttttacgtaaaggatcttgtcatctgcaaatagagataattttacttatttaatttagttgcctttttttcctcatctgattgctcttgcaagtattctattgaataaaagtgatgaggctggccatccctatcttgtactcaatcttagtggaaaagctttagttgttccccactaactatgattagactgtgggtttttcataaatggtctttattgtgttgaggaactttccttctatacataaactattaagagttttatcaagaaacgttgctgaactttgttaaatgcttttactgcatcaattgaggtgaccatatcgttttatctttcattttgttaatgtgatatatcacattgattgatttacatattttaaatcagccttgcatgccagggataaatcccacttaaacacgatgtataatgtttttgatatgttgttgaattctatttgctaaaatttttttaggatgtttgcatcagtgtttaatttattggagaagttgacctgtagtttttgtttgtttggtgtgtgtgtgtgtgtgtgtgtgtgtgtgtgtgtgttttggtttggcttaggtattaaggtgatactggcctggtaaaatgtgtttggaattatttcctctcgctctgttttttcgaagagtttaagaagtaaactcccaggggatgggagtgactctggacatgggagtgacatgatagtgactctggaccctgcagtggtgggacacagcagcatctctgtctctgtgaggccaggcgcagcatcagcaaggaccccagaatggtggagcactactgtggcttgggccctcgggggcagggaccagtgcagcaactacttctctccctggggaggcaggtgcctgggcaactcagattctccagagctagtccagttccaaggaagcagggttctacagttgtttgtcctgaagggcaaggtaccccagttcagccaatgccgttttcctgggatatgggggtgccatgttggctcatccctggcaggtgtggctgctcagctcagccaagacactgattccctgtgaagcagggcagcgcttcagctctcatgcagtggggggtgtgactgctcagactggccaaggcactgattccctggaaagcagggcaccaagtcagctcaggctccaaggggcagggcgcaatggcagctgggaggggaggggcacagcagcatggccctgcaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcatacacctgtttccccttccactttccctatgagatgaagcagcacaagaccctcgccagttgtgctgcccaatctcggacttttcagacacaagcagggtgagccaaataaaccttttttataaaataagttaccccgagtctcaagtattctgttacagccacactaaatggcctaagacagtgtaacagcggctcgggggtggtgggccactaggtgggtgtgatatagagcaacaaagcctgaggatggaagaagggtgcggtggcagctcaccctgggtgggacatgctcccgaagtggtccaggtccaggagggcacgttgcagcagcagctggtccatgggggtggggcacaatgtcagttccttctctgaggggagtgctggggctactgggcccctcttgcttccttatccctgcagggagacatcccctctgcttcaggctgatccctctgggggaatgggtggtgggggccagatgtttccttccctcctttatgtgaccgtcctggttttctgtgctctgctggatttctgctactccttgatgcactctggggctctcttttagtgactttcatcaaaatatagatgtttgctgctttggctgtctttgtcaggggatgagtgcaaggggctattgatcagccccttgctggcatcactccctcttaaacttttcactgggtactcttttgaactattttttcccccaccgtatacatgtattttttaaacgttaatgtgctaatttctactgaagcaatgtggatttttctgaaagttttaatgttttaataagctttttattgaaatgttaatgtccacacagaagagtgcccgaatcataagtgtgcatctagatgaactgtagcacaccaggctgccacgccctggaccaagcagtagcctcgccctgtggcctctcccaggcactgctgccccaacccacagaatagctactttcccagttcctgatgtagatttgttctgcctggttttgacttctataaaatacagcacattctgtttagcctggcttctttggttcagtattacagaacacatccatgttcttgtctatggcagacattgatttatcgtcattgttgagttccattatatgactgtgtcaccatttttccattgatgagtaaaatgatttcctatttttggctgttatcccacggccctgaacactaggtctggatatgggacttgcaggtatgcaggggcacacgcacttctgctggaggatccctgggtggggtggagactccagggcacctgtgctctgcttcagtatggagtagttggagtgtattgcttagaacaaaagagatgagacactaacactgtgtgtatattctaaatcatatatcagtgaagaaatgtgatgtttgcaacatcttctctggggatgctaaccccctaagtcattattaccatgcatgtaagcacctcacctagatctgcactccatctagcagtgagaaattccaccataatctacacaccataatatcatcaatgtgtctagaagtcagatcctctatgtgtgaaccaagacaatgcctggcaaacaagacagctgggctctcaggtctctgcaccatggggaggtgtgtaaggccattcttgaattactataaagaaatctctgagactggatgatttacaaagaaatttacaaagaaatgttgaattgactcacagttctgtgggctgtacaggaagcttggtgctggcatctgctccttttctgggatgcctcaaggagtttttactcacggcagaagatgaagtaggagcaggcatctcacatggcagaacaggagcaggatagagagtgggtaggaaaggtgtcacaaatttgaacaaccaaatcccatgaaaactcactatcataaggtgaaaaccaacccaagaaggatactctctcatgacccaagtacctcccacaaggtcccacttccaaccttgtgaattacatttcaacatgagatttagtttagcatccaaactataccattattcccctggtctctaaagtctcatgttcttctcacatggcaaaatacaataatgtcttcctaacaatccccaaaactcttaactcattccagcatcaactcagtcgaagtccacagttcagagtctcatttgagttaaggcaagtccctttcacctataggccagtaaaataaaaaacaagttatttacttccaaaatacactggtagtacagacattgggtaaatattcccattccaagagagaaaaaactgccataaaaaaagggctacagatgtcatggaagtttgaaaccccgcagggcattcattaaatgttaaagctccaaaataatctttttttgactccgtctcccacatccagggcacactgatgtaaagggcaagctaccaaggctgagggcagttctacccatttggctacgcagggttcggcccctgtggctactctcataggctgttaagtgcctgcagcttttccaggtgtaggatacaatctgccagtagatctaccattctggaatacagaggacagtgacctccttcccacacctccactaggcagtgccccagtggggactcggtctggggcctccaaccccacatttcccctccacactgacctagtagaggttctgtgggagggttctgcccccacaacaggcttctgccttagcacccaggcttttccatacatcctctgaaatctaggtggaggttgttgaggctccagcactcttgcattctgtactcctgcaggtttaacaccacatggaagcttccaaggcttaacatggcttttgctccccaaaactgtggcatagcattatctggagcctcttgagccaaggctggagctgaatcagccatgaggttgcacaggactgtggggccctaggccagacccagcaagccattcagttcacctaggcctcaggacctgtaatgtgagaggctgcctcagagatatctgaaatgcctttgaggtctttttcccattgtcttggctatcaacacttggctcctctttagttacgcaaatacctctagcaagtgattgtttcgcagcccacttggattcttttcaggaagaggggatgttattttctgccacatagtcaagctgaaaatttttcaatcttctatgctctgctttccttttaaatataaattccaaattaaagtcatttctttgatctcacatctgagtataggctgtagacacagccaggccacctcttgaactctttctgcctagaaatttcttctgccagatactctaaatgattgttctgaagttccaacttccacagattcctagaacatgaatagaattcagccaaactctttcctaaggcataacatgggagatacttgccccagttcccaataagttactcactttccgtctgagatgttgacagcctatgcttcattgttcctaacaccatcagcattttgatcacaaccatttaaccagtctctataaagtctgaagcattttctaatcttcctgttgtgaacccccaaaattggacacaagtctcagttaactcagaaagcttattttgccaaggttgaggaggcacatctgtgacacagcctcaggagatcctgatgacatgtgtccaagatggtaggggtacagcttggttttatgcattttaggcagacatgagacatcaatcaacatgtgtaagatgtacatcagttcagtctggaaaggtggaacagctccaggtgaaggcaggacaacttgaagtggggaaggggcttccagtcttagatagataagagacacatggttgcattcttttgagcttctgatgagcctctccaaaaggaggcaatcagatatgtgtttctctcagtgagcagaggggagactttcaatagactgggaggcaggtttgctctaagcagttcccaggttgagtggggtcccaagatttgttttcctttcacactgtcttctcctgagccccccaaacccttccaacctctggccatgactgagttccacagctgcttttgtactatcaggtatcttttagccatactttatttaccaattatctgtgttaggacattgttgcattgctacaaagaaatttgttgggaaatttacaaacaaaagaggttgaattggcttatggttctgcaggctgtacaagagtcatggtgcctccatttgcttggcttctgaggacacctcaaggggattttacttggtggaacatgaagtgggagcagacatctctcatggcagggtgggagcaagaaagagagtaaggcaggaggttccacacatctaaacaatcagatcttgcaagaactcactcactgtcatgaggacagcaccaagcctcgcggaatccgcttcaatgacccaaccacctcccaccaggtgccacatgcaacattggggattacgtttcaacaggagattgagagaggacacacatccacactatatcaggaggtgtgtgccttgcaaccatcaggggatgctgcaggactgccctatggtccctacacagctgcttagtaagaaccattcactccaaggaacctgtgccctgtgctcaatgatggggactcaggagctgtgtcctctctggcctggcagagtcccctaagcagagacctgtgtatggtctcggcaggtgcttcctcccagggccctcccgagggggaaaccaaaccttcctcctcctcagtctggagtgtgagctaagcttcagctccagggctcagggaggggctgggcagtccttggatggaaacatatttgcatgagcagcccctcctctggcagaggatggagaagaagaggagacctggggcagctcaggcccactgttagggctcaggggctgtgtccaccatggcctggactcttctccttctcgtgctcctctctcactgcacaggtagggaaagtccttataaactgagtctcagtgtccaacctacaccatcccctgtggctcagacctacaagaagctttaccctgggaactgccttatcacccatgatgtctgtgttttcaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaagtaagacaaaaccctcccctctactctcctggtctagtgaaatcacccctgctggtggctctgaccaaatctagctcagggggtgacatctgttgtctcatcgacagcactggagctcccacggagaagtaggtctaacaaagtcctaccttgctcgcatttcacaggcagacatcccttgctcaggggtaaaatctctcagtgttgacattgaagaaggcaagagggctgggttggggttcatctcagctcagagtctagaagtgactcagagatgctgctggtctgagagttttaatatgagccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaagaagacctgagtaaatgcacagataatccttttttttttttttttttttttgaggcagagtttcactcttgttgcccaggctggagtgcaatggcatgatcttggatctcggctcaccacaacctccacctcctgggttcaagcgattctcctgcctcagcctcccgagtagctgggattacaggcatgtgccaccacgcctggctaatttttgtatttttagtagagatggggtttctccatgttggtcaggctggtctcgaacacctgatctccggtgatctgcccgcctcggcctcctgaagtgctgggattactggcgtgagccaatgcgcccagcccagataacccttttttttttttttttttttgagcaggagtctcgctctgtcgcccaggatgcagtgcagtggcgcgatcttggctcactgcaacctctgcctcccggttgaagtgattctcctgcctcagcctccctagtagctgggactacaggcatgtgacaccatgcccggctaatttttttttttccttgtggcaacggggtttcaccgtgtttggtcttgatctcttgaccttgtgatccgcccaccttggcctctcaaactgctgggattacaggcatgagccaccgtgcctggccccagataaccctttttatgtgagagtgtagagaatgttgctgcagctggtgtgggatgggggatggctgggttgagactgtgttgtcacctgcagtgtacacctgaggtgacatggttctgaacatcactttccccattgaaggcccgagtgacctatcacttgcttctcaaaattcaggaactaggtgactctaggagagtgcacaggaagctttctgcatattctttcaagagatttcgaggtcactgactcttttttcaagacttaaacacaaaatccacatccatcattcttgcgtaaagagaccattcttttttttttgagatggagtctcgctctgttgcccaagctggagtgcagtggcatgatctcggctcactgcaagctctgtcttctgggttcatgcccttctcctgcctcagcctcccaagtagctgggactacaggcacccgccgccatgcccggctaattttttgtattttttagtggagatggggtttcaacatgttggccagaatggtcttgatctcttgacctcgtgatccacccgccttggcctcccaaagtgctgggattacaggtgtgagccactgcacccggcccaagatggggtttcatcatgttgacctggctggtctcaaactcccaacctcaagtgatccactcacttcagcctcccaaagtgctgggatgacaggcgtgagccacagtgcccggcctagtacattgtttaaatggtgcatgtaaaacctcatggtactacaactgcctggtgacagactcaccagagtaaataactatcctgctgttctccaaccacatgggattccccaaacaaagatttgttgagtccaagatgcatcatgccagaactcttgcagtcatacacataatttgtttcattttaataaatacggttatcttttttcttcagtttattgtttttaatgtatcatcttctaggtttcattacacatcaaagatgaataatttctctcatctttaggacatgctgaaaacactcattagtgattttgaacagtattatttcctaaacatcctagttggaatggttgatcctaaaagctaccatgtgtcaggctcacctgagtgcagactgtggtctaaacaagctaaagttttaattcttccatcttcaaatacggagcatatttgcttgttttgctctttagcaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacaggtgaggaaatgagtccatggggctggtcagtgctctcgatttcattctgccataacaggactttgtgtagtcaccacctgagtcctatacagtgaacagccaaggagacatggacagattcacccctgaggaacccagtagaatgtgaagtctgccctgaggtcacgaagaaaagactcggggggctgcctggcctggccctgatggagggggccatggacagaacaacggggaggcaggggtgtctctgagaggctctggtcaccttgtcatacaatggtggtgtacaatgtcgcaccatggacactagggggcgcctgcgcaccattcctgagaagactgggtgtgatgagagcaggaccagcgccacctgtcctgcttggtgccctatgcttagggctcacagatgtcaactctccaccccctgggaccacacagccccacccctggcactctctgacatcctcaggcagaggagcttgacccagggcccagggtgggatcagaaagctggagggtctgatttgcatggatggaccctccttctctcagagtataaagaggggcagggagagacttggggaagctctgcttcagctgtgagcgcagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctg

SEQ ID NO: 2493 - DNA, 11575 bp, Homo sapiens
gtgcttcacattgcttctctttattttcaacagtttctttacaacagtctacacagggattaactcctacatgtacttcccaagccagaatctccctttagaaattcagattctatttctaactctataagatgtatctccccaaagatcacattaactcctcaagtcaacatctgcctatccccaacttcccctttttttcctcactgaacatttgtctgaatgttttttcctcactgaacatgttttcctcactcacactgaacatttgtctgaaactgtggctgctttgttgcttcaagatgcatgcacatcctggctttagtgtccaagtatgcagaatgaagcatttgatatgtgcacccagctagttaggcatgaaacaggggcacaggatgggctccgggtcatagaaggttctgtccccacagtgaggacaggggttggcactaagccagaccatgctgggccgccccaactcacacagcaactccctgagcctggcatgcagataggcaagcctctccaggtggagggtaccatggatgtcctcataactctccagggggacaggatacagcacgtgggtcagattgctcagcccgatgaggtgctgcaggagactctgcaaggcagatatggagatggaattcccgtagaagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaagcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaaggaaaggcatcagtgaattttagtatttgaagatacaactgaaaatactttctttcaactcgggcttccttctgccactgcctgggccccagtcacctctatctctgtgcctgatgaagctactagggagtattcacagtggacaaactggggcaaggtcagcaacatccaaagggggttcccaggctgcagggctaccttaggtcactgtatcatcagcaaaccacctatcaatttttgcaatttctctgttgttccttctcccacatctccagaatcctgcatttcccacctattaccctaactggaattctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgataccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggctgagctgcttctggctctggaaatgagtacagactggccctgtttccagaccatacagtccagaagtcctgatgagagttcttccgtaaatccagcacttgaagtttccacctcctgtggggaaaaacaggtaattagctgagatgatgctttaagatcaactcaaaataagaccatgagtctcataatgtaggtaagaaccaaacagacatccaccttagatctgcacttttacttcgtacttcaggcatcagctgctccctttcccactaggatcctgggatccttcctggtccccaattcccaccccaccaggaggaagcaggtgcatgttccttcagacacctctgcattttaatcagtgccccatgtccagaagcccattccaagagtgacccctgcagtagccccaaggcctccctgaacttccttgctggcaaccatcagagcctctggcccagccttaggcgctccatgctccctgaccccagctgcatcctgctcaggttcccagggccccacaccaagctgctaggtcacccttacctggggcgaacctcctgggcaaggagcacatcaagtccatcaagcacagctttgaaggtctccaggtgaagatgttgtcccttcatcagcactcccagagggaggcaggtgaagggccaggcctgcaccattgccttcagggtctggctgtgtctcccgtcaaaggctgccatgaagagtggcgggaagagctccctgggcagcaactccagggcggcaatggccagggcctcatccttcagcaggctctgccctgccagctccacaagtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcttgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatcttgtatactagatatcttgaaaaagcctccaccctccagcacagtggctcatgtctgtaatcccagcattttgggaggccagggtgggagaatggtttgagcccaggagttcaagaccagcctgggcaacacaaggagacctcatctctattaaaaaaaaaaaaaagaaaaaaaagaaagaaaatgtctttaattccaaagcatctgaaaagaaaaagaaaaaaatctatggaatattttttaaccttttagttaaaatggaatattttttaaccttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacatactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccagacctctgggaagaccacaacattgactccatggcctctgggtccctcctctggcccctctgaagctattacaggcctttctgggcatacctcccctttcaactccacgctgccaacggaagagccaaatctaattacattcctggatctccagccagtgaatcctgatggggttttttacttacttcaggttcaactgattgaatgggatgtctatttacaaaaaggaaagaaaaagtgaacaaaaccacccagagagtataactgttaggggaatttttggccacatcaaaattacccaaatagtccagttaagatagctttatgaagagcatcatgacatcaccccttcccactcccaaacaatccccaagtatcaaattgtcacttataccccatgttccctaacacagcaaatcacatgcctatccaaggaaaaagggaggaacaacagaggggtggctggtcttccagactttgaaagtcaaggctgtcctgaaggaaggtgggtcaaaattacactacaattaggagttagtcagaagtaaggctgggcatttgtaatgggactgagtggattaccacaaagacagataggtttttttgggggcggaattgaaagactttggcctggatggagtagagaaattaaaaaggggaatggctaaggaagatgaaagatagttccagtaaagccaaggtaatcactgaggcagggagggagttcaatcttcctccctccctagagggaaagggtgttttctcccagaaagtcaggatcctcttggcaaacagccttgacaagattaaatctaggaatgtgggctggagaggtgggatagagagtaatattggtgaccaaacctaggacagcaacattttcaagtctgaaagaccttgtggtttcttaggaatcttggagccaggaaagaaataaacaagggctgaaagcacacatccctgcaattaaagaagttgtcagaagaccttctctttatggttaggtgtcctcttccacactggggctgttcacaagcagcaggtcaggcctttaccacaaacataatctccaatggccagccccttcctaagtattactaatgtttccacacttcaagaaaacagctgttctttcttgcccctaagctgctcaggtacagagattctggtcagcgagatgcaatcaggcctatcaattagactcagtttttctctatttccatgctaggcacagtgcacaaatacattttccgtcacaaaaaattgaagttatatttggcatttaaggatctgcttagggatgattcctatcctgggcctgatcacccactggtgcttttgaagttttggaacctctccacccaaagaattctccaggccattctctgcctcatgcactgtgaagtccctacaattcttatattctactggcaagtgtccagctggaatgtcttgcggcctgactttgtttactgtggcctgcgtaaggaggctgtaattcgttgaaggatgttttccattttggttctctctctggagactttctcctacttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctactggttcttatggtccttgtgggctgcacaggccagagtggcctctgagctcatcaggtgggtggtctgcaccctcctctctagtcatagaatcccagtggggacccccgaagtatctgcaccaggtccttcaggtgttttttttggagtgcagtggcgcaatcttggctcactgcaacctctgcctcctgggttcaaacgattctcctgcctcagcctcccaagtagctaggattacaagcacacgcccccacacacggctatatttttgtatttttagtagagatggggtttcaccatgttggccaggctggtctcaaactcctgacctcaagtgatctgcctgtctaggcctcccaaagtgttgagattacaagagtgagccaccatgcccagcctctttttcttttttagagacagggtcttactatgtttcccagactggtcttgaactcctgggctcaagtgatccacccatttcagcctcccaaagtgctgggattacaggcttgtggataccaacagcacccgagcacggtcccacagtccaacgcactgtgccgtccttgagcctttagttccagcacaagtctcccggcttcaacccaggttgcatgttctccctgatctccccaggtggcacccaaggatgaggcagtgcaatcttgttgctcacttcccaggaccgacacttacccctaatggcccaagcccatggggcagtgagatcaaagcctcctggagctcatactctctgacaccactggaagtgtgggcttttgcgtctgattaccccggggaaaggttctgaatgtaatcgtggctttggcaataaggtccacaatgcattaagatttttttttttttttggaggaggagtttcactcttgttgcccaggctagagtgcactggcaccatcttggctcactgcaacctccacctcctgggttcaagcgattctcctgctcctgtctcagcctcccaagtagctgggactacagatgtgggccaccacgcccagctaattttttttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcaaatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagagagttcaccacaccgcgaagttgctggaaggaaagaacgagacaatggctcagctaagcgccctagccgctgcgtggggcggggggggcggcggtgggggccggggggctgggcagcctggtctgaccaatccccgtttctcagtccttccagggcaaaatctcacgagatccagtgaggtcgcccagagagtcgagaggggcttgttttcaaagactgggaggaggaggggcagtgggggaggggcagtggggggaggagcagaggagaagggagcaggaggaggggaaaaggggagaggaagttggagagcagaggaggctgggggtggggagcagatgggggtggggaaggaggggagatgggggtggggaaggggggcgggaggagggttaggaatgggggaaggaagacagggtgggggaggggtgggcatgggggaaggaagacagggtgggggaggggtgggcatggggaaagggagacagggtgggggaggggtgggcatgggggaagggagacagggtgggggaggggtgggcatgcgggaagggagacagggtggggaaccgagaagaaagacagtggggggggatggaggaaggaacacagggtggggtggggggtcgggatgggggaagggaaacaaagagtggtggaggcgtggggattaggaacggagacagagggtgggggaggggtggggtgggggaagggagacagggtgggggaggggtgaggatggcggaaggtagacaaggcgggggaggggtggggatgggggaagggagacagaagggggggaggggtggggatgggggaagggagacagaaggcgggccagggcgggaatgggggaagggaaacagggtgggggtggggatgagagaagacagaggttgggggaggggtggggatgtgtaagaaaaacaaagggttggggagggggagggaaaagaggcagagagtgggggagggggtggggatgtggaaagaaagtcagaaggtggggggtgaggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcgactccccgtgtttccactctccacagaaatccacgcattcacgcccctcccctcccccgagcctgcagaggactccgccctgctttccctacattcagggctgctccttttgtcgccaatacaaacctgttgacaggtcacgcctgggaagcgggtggggtgtcccggagcggtgctgaggcgctgcaggcccggcttctggctgcgggggagctgtaccctgaagcctcgccggaactcg

SEQ ID NO: 2494 - DNA, 6554 bp, Homo sapiens
tttgtgtgattccatttatttaaagttcataaacaagaaaaacctctgaggtcagaataagggatgccttgttgggagcatttgactgggaaagggctcaaagactttggagctacttcttgacaatagggagctgatgagatgtcactgtgaaaaacaacctgacagttgatgacattgcttgctagcatctacagccacaatgcacatatggcctagcctcacttctgcctttcggaactcctggaagtcagtcgaacatattttcagctagaatccttgctgcaagggagtctggaatctctagtgttcatagccgtcttctttttagtttttacaggagaagactgagggtcagtgttgctaacaataacggaagccataccacttgatcctggctgaactgaagtttgaataataacttttgtttcacgagggaacccttgcagttgctccggctttttaaatgtttgatggtccttggttttgtgctctatttcctccttcaacgtcaaaaactgtagccggcacttggaacactgaaggaccctccttctgctgtgcctccaacaatgattcatgtatggtattgcagttttgaaaagtttgagacaaaacagacaaagcaaattctttgtgttttcatggcacgttctaaaatgtgtttccacatcagcaaagaccgacgatctgtaatggcaaacctggcacacgtagggcatttcgccaggcttatgatggtccttcatgtgttgtaagaggacctgatctgtttcaaatgacaattcacagattttacagacagcagagggccccatggcgatgtgtacactatcaatgtgacactgtagctggaagggagtgggaaactgccggtggcagtgctggcaggtggtgtggtcttcccagctgtcgttcctctgcttctcaaattccaaatgatgcttcatgtgattcataaacttaatattttttagaactttcacgcagctgaggcatttaaaggtggtgtgagtcttctgttccggctgcccatctcctttatgctgtccatagtaaaagttgctaagtaacacgatgggattttctttcttgggatcaaaggtcttgttttgacttgctagacttgaaatgtctgtcattgccaggccagactcatttgctctctctggatctgtaagattgaaatgtgcctttccattagcatcaggccaaggaaatgttactccattctgaacatggtttgatgagttgcagatcccctgtgagggtgtatttgtgcttattgtagaagacatatctgaagggaccacagctaaagaaggtacccctgggattccatccctgagtttaacccttttggaatctctgctgtttatatctgaagtggaaagtcgctttgaatcaggagaactctcatttctgcctcctccagagaccatagctccaactagacactgagtccctggggggagcgaatctgagtaattgggagaaacaacttgtggtgagctcattttataaccaggttcagatgaagacttcatagtgacaggactatctgtcgatcgcccctcagacagagaaacgggcatgatggcttttgccatagaggtcacatgatttgcaggctgcgacacgtgagcaggatattgacggaagtggcctttctttcttcttgactttgagcctggggtgactctgttcaaaatgtttgaaacgactggttttgaatttgaaatcatcccgacaaagagaacttcagcatctctatgtacatgctccaccccaacatagatcagatctggatcttcatcatcctcctccctttgtttggattctctcaaattcttctttggtgattccactttcttacacaaaaagatatctcccattttcaatttactttttgcttgaagccactggtctcttcaacttccagagctgtctttttacaaattgccacctaagtgcaaccatgtgacaatagtcaatatttatttcgaaagacaaaatcattactttattgtatcctcccttaaaacactgagataaccatcaacatctctattttacacgtcagaaatgaggcttgaaacattttaaatggcataataatttcaaatttacctgtctctcctcccctggtcttctgcagttgtgaggcaaaggaagcaagatttcaggaggtgcagatggaacatctcagagtgcttgcctctaaattttgcactctagatgcctcactcacctcctcctcatcccacaggtactctctcagatgtctaaggtttctaaccaacttgaacaaaacttctctcaaaaacattctgctcctagcctgggcaacatagcaagaccccatctctacaaaaaaatttaaaaattaaaaaaaattagcttggcatggtggtacacacctgtggtcccagctacttgggaggctgagccaagaggaacacttgagcccaggacttcaaagttatgttcatgccactgcactccagcctgggcaaccaaatgagaccccatcacacaaacacacacacacacaaatcacaacacacacacacacacacacacacacacacaccctttgctgttcctgtaatgttccttttctcagtaaactcagttgctcagtctacaaacttcagagtcatcctttgccagactttctctcatacactacagccaatcaattagcaaagctagtctgctctatcttttaaagatatccagaatctgactactctcttccacatctactgccacctccctgatggaaggtaccatgttctctccctggatcactgcagaagttgccagtcttaaaagttttgtcagatctccccatggtggccccaatgcccctgttaaaatatacaggggagcaagtatattttgctcttaagtcttcaatgactttccatttcattcataggaaataccagcaaactttaaatttctccatggaaccttaggtcatcatcgcccttgctaactcctctgttgctctgatgcagccatcctgagctccgtgaatctggaacacaccaggcctttttctttttcagaacttttgttgttcccggacattgcgtgcctctttccccagattaaccccatctgggctcctggtctgcctcagtcccatggttcctcttcagcaaggcttacctgaccacaatatcaaaaatcacaacctccttaactcatatgttcaaaccctcaatgttatttttcaacttagcatttatcactgcctaccacacaatatgtaaaatatatcttgcaagcccaggagtttgagattacagtgagctgtatcatgtcactgcatccagcctgggtgacagaggaaaggaagactctgtgtcttaaaacaacaacaaaaaatgggacaggtgcagtggctcgtacctgtaatcccaacactttgtaaggccaaggcgggaggattgcttgaggtcaggagctcgagaccagcctgggcaacatagcaagacccatctctacaaaaaatttaaaaatataacttgtttcttttctgtgtttacccactaaactgtatgccacatgagggcagggagttgtgtttcatttactcctcagcttatagagcaatgtctgtcatactgtgcatgctaaatctttgttaaataaatagtagctgttattaatatgatcatttaggtgtaccagaggctctaatccattattccagattctctaagcatttaatgaaatccaaatccaaatgatttaatactgttgtacaagggagaaggtaaacctgtgtgtatgtgtgtgtaaattgaaacaaaagttttgtcaaatactctaataccttcaccttaccgcaagggataggctctgataccttctatgccatattttattgattctaaggtataggcttagatttccattttaacatctctaaatcagattgcatctcatcatagcatctcatcaatataaaatacatttcacaatttgtttttgcagtatatatttttatttcatagtggaatcaaaaatgacatatctcagatccttttgtgaggataagcgtgatgcttgggttttcactcatgtgagatgtgcttccctcaaaccttgttatatcagcatgtttaacatctgatgtaaaaaaaaaaaaaaaaaaaggagagtaatgtatcttttataattgatggcatctttttttttttttttttgagatggagtctcgctctgtcgcccaggctggagtgcagtggcgcgatctcggctcactgcaggctccgccccgcggggttcacgccattctcctgcctcagtctcccgcgtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcatgagccactgtgcccggccaattgatggcatcttatagtcagtgaaaaatcctatttctttttgtaagctgacagcccactaaacttgttttgtagttctctaatggatatcacctacattttggcaaacaatggtttaagacagaaattggaaaattggcccttcccctgtttttgtacagtcaggaagccaagaatgtttcttacatttttaaggtattgttttcttactttttttttattaagatttttttaaacttgtacatttttagatttgggggaataaacacgcaaaaggaagcggggcgcggtggctcacgcctgtaatcccagcacttttgggaggccgaggtgggcggatcacttgagctcaggagttcgagaccagcctggccaacatggtgaaaccccttctctactaaaaatacaaaaattagccaggcatggtagcagatgcctgtagtcccagctactagggaggctgaggcaggagaatctcttgaacctgggaggtggaggttgcagtgagcgaagatcgcaccactgtgctccagcctgggtgacagagtgagactgtctcaaaaaaaaaaaaaaaaagaaaaaaggaatattttgtgatgtgaaaattatataacattcaaaatgtcagtgttcactataaagtgttgtggaacacagccataatcatttttttagtgctgttgtccatggctgctttcacacttctatgacacagttgagtacagtagtacccccttatctttggggcatatgttccaagacccccgaagtggatgcttgaaactgcagatggaaccaaattcaatatatactatattttttcatatatgtacatacctatgatcaagcttaatttataaataggcacagtaagaggttaagcataacaaaataattataacaatatactgtaataaaagatatgtgagatagtgcgtggtggctcatgcctgtaacctcagcactttgggaggctgaggtgggtggatcacctgaggtcaggagtttgagaccagcctggccaacatggtgaaacccatctctactaaaaatacaaaaattatctgggcatagtggcgagcacctgtaatctcagccacttgggaggctgaggcaggagaatcacttgaacccgggaggcgtgggttgcagtgagccgagatcgcgccgtggcactccagcctgggcggccagagtgaaactccgtttcaaaaaaataaattaataaattaaattaaaggtatgtgaatgcaatctctcgctgacaaaatatctttatgtactgtagatcttggcaaccttagcatacgattttgttttctttccttattatgttaaaaactttcccattttcacttaaaggaagcaagcactttacagcttctttttggcatatttcaatcgccagcattgctacccttgtactttggggccattattaagtaccataagggttaattgaacacaagcactgagataccaccaggacagtcactctgataactgcgaccgctcctaagtgactaaggtacagagagcgcagccagccaacagcatggggactcaggacaaagggaggattaccatcccagggcagggctgactcaagagcttatcacactactcagaagggctggcgacttaaaatttatgtattgcctatttctggaattttccaattaatattttggaacctcaggtaactgaaagcacagaaaggaaaaccctggataagggaagactactgtagttggagcagagaattgcaatacctaaaatatttgccatctagtctttcacagaacaagtttgccagctctagttttagaggagcaaaatgaaagatagcaaatttctcagctcaccagttcctaaagttgcgagtgcatccagatgattcagtgcagctcagtatgttccactctgggccacaagggaaagcgaagctggagcttccttgtctccacctccgggagaaatttgtccagagaccggcagcactgcttccgcaggcgaacaacgccgcttgctcttcaaagtcctttct

SEQ ID NO: 2495 - DNA, 24735 bp, Homo sapiens
tttcacaaaacattttattactataattgatattttacttataatttttggcaacattaataaaataataaatttcacctgaaagaacaagcgagcaaaatagacaaggaaattcacaaagggcaataacaaaatagtaatcttgacatattcaatatatttgtaaacaaaacaaagtgacattgccttaaaaatatatagaggtatcaatagaaaaacagagaaagctcctgaaagaactcactatattaattttcatttggttgcaggcacagaaattgactcaagctagctcaattctaagacagaagcaaagcccttgatgctgatcgctttccagctttttcatgaaaacctaggaaatttaaatactttgaagaggaagaaaagagtggggagagagtaaagtgcctttaagaggaaaagtagaagtttttttttttttttaaagggagatctcattgtcagtggcattttaagagccttgaagctcaatgaaccaaaggaagtgtcaaacaattaagtgaggtagcaagccatgcaggcctaggggaagggcattctaagaaagacaacagcatgtgcaaagtctttggattgggaagaatgtgatttgcttaaggaatagcaaggccagtgtgtcaaaatagtgcgtcattggggaaaacagtggagaagcatgacagagaatgaaaaagagaggaaggaggtaggcaggggccagatcactggaatctacagttggcaattaatgaccatatgtactccttaagagcatgctttaatgaaactgcaaacaacagtgttgataataccaaccaatcactcaacatacaactaaaacacttcatatttttaccacagaaacagaatacgggaggtaagtatgaaaagtctgtagatctatttatacacagtgggagtatctacctgagacaagaaaaactggcacacacacacccacttgcacacacataccctttcttcaactaaagaaaggattcaggctgtaattttagcaaagtgtcttaacccaagcaacgtaactgaaaagacctagtatagtgttcaaggtgcaaatcaatcaaatgagtgtccggcaaataaatacaacagaatctatggatctagagtcagaaaattttctaaaatgtagataatatactcacaacttctttgttatctgtactgccttctactctaagagggatgctaagctcttaattatctcttcccggatttttgtgaaagcttaggaaatttaactagattgaggagggaagaaaggagtggggagagataaggtacctttaaaaagaaatcaaggaaaaagggagagatttctccagacctatgtctacagccaagatggcggattccttgactggtgaagacaggctgctgggcaccttggtcaggggtggaggaacaaaggatggcaccagaacacaagcagggagacaactccgggagtccacagaggcagccaagactgctgatgttcaggaaccaatactcaaaaggtactccagaatactgtgaaacagcccctggggagagcaagggaaaaagattcacccatagtacagattagataggatagatcagatgaaggacattaactctaagtcttaaaacttattgaattagagagacatttcttgcacactggtgtgtgtcaggtaagacccaaacagcattagtgtcaaaaaactgggaaactatacatttaacagaatagctgcaagctgtaatacattcatgtccaaagcaagacataaagttgcaagcttcacatgttcaattagggtaagatatatatgcacagaaaaatataaagccattatgggtttaaattcagtcagtcaccctgggctatttttgtccactgtacctactgttgttgggacagtcctcattccagcttaacagtgggaaaactaaatttagcccagtccaggaactggacagacaccacttgtttggcccttttcagttaaaactatgggtccagtacagttcaaattatagatattagggcttcttccccttgggaaacttgctttacagctgtggctgagaatatggccagttcattctccactaacggctagccagaagggagaggagagggaatgaatcaaattcacctttagatcacagaacaggaagtcagctagtaccaggcaccattctattaattttattgctatttcacctcaaaccaatgatacatgacggctgtttgatgtctgcaggggcccttcaccaaacaaaaccattttactttgaatggtttggcttccttggatgttttcaggtaggtaaagatactctgaagcagtgttccttttgacctggccccaagactagaatgaatgtgtgcctatccttcaactagaacaaagaaccactgctctccctcaactaacctccgccttcttggtctctgctcacgcagcagcttctctttcaattccacatcctggcttttcagaatcttttcaggttattttatgccagcacagcagaggcacttctgggaattcggcagcaagtgggccagggcataacaaagccattccagtctgactagagttaaccatgaaatgctgaatgcatggaaaaagctgtaaagaaaactaagtatttcaaaaattctatgaattctgtatatagaaaaaagagctttcaagcttaggagtaacatgaaataccaaaacaataaataggtgccaggggcagtgactcacacaacccagcacttggggaggctgaggcaggaggctcccctaaggtcaggagttcgagaccaccctgggcgacataacaagattccatcgctacaaaaaattaaaataaaaaactagctgggtgtggtggctgcgcctgtagtcctagctactctccaaaggctgaggcggaggaatgcttgagcctggaagttcaaggttgcagtgagctaggatcacgccactgcactccagcctgggtaacagtgagaccctgtctctaaagtaaaaaaaaaaaaaattaaaattaaaaaaataaattaatacctttctctctcacacacacacacacaaacaccttttatgtgttaagccagatacagttaacatgaaaaccagatgttttaaaataatacctcaaaattcagatcaaataatatatatcctgaatcttgtttaaaaagtcatatataatccactagtttcactatttttggtgctactgaataatgtatggtttgtattttttgttttatgaggttttttaatttggtttgaaatacttgctttagatttactgaaactagaattaatgggacttttttgaaattttgcttttagacctggggagtgatggttcagagtcagatgtgctcacagttatggatgctacatccactgatcctggctgaagaggttccagtgacacttgaatagtaacttttgtttcaggaggtaatccttctagttgcttaggcttcttaaacatttgatgacactgggtcttgtgctccattttctccttgaaagttaaaaactgtagccggcacttggaacactggtgtgcactctttccccagtggcccctataatgacacatgtatggtgttgctgttttgaaaattttgagacaaaagggacaaagcaaattctttgtgttttcatggcacgttctaaaatgtgtttctacatcagcaaagaccgacgatctataatggcaaacctggcacacatagggcatttcgccaggcttatgatggtccttcatgtgttgtaagaggacctgatctgtttcaaatgacaattcacagattttacagacagtagagggctcctgggcagtgtggacattttcgatgtgacactgtagctggaagggagtgggaaactgccggtggcagtgctggcaggtggtgtggttttcccagctgtcgttcctctgcttctcaaattccaaatgatgcttcacgtgattcataaacttaacattttttagaactttcacgcagctgaggcatttaaaggtggtgtgagtcttctgttccggctgcccttctcctttatgctgtccatagtaaaagtcactaagtaacacaatgggattttctttcttgggatcaaaggtcttgttttgacttgttagactcaaaatgtctgtttttgccaattcattttccctatcaagatttgtatttataggcttgaaatggatattgtcctttggaaaagctgctggaaaaggtgctccattctgaacatggcttaatgaggtatgaacattatttgagggtgtactttgctgagtattcattgtatgaaaggtatctgaagggaacgaagctgaagaatttccttctataattccatccctgagtttagcccttttgggatttatgctgtttacttcgaaagtggaaagttgctttgatacacgaggactttcatttatacctcctactgaaagtgctgtacttactggatgatgcaatgaatctgtgaatgtaatcaaaggagaaggtaattctgaagagttattaggcacaacttgtggtgaactatttctataatcaggtttagacaaaggctcaataataataggactatctgttgatctcgattcaagttgggaagctggcaggacggtcactgcttctgatgtaacggtctcatgacttttaggctgcaatttgcgagcagtatcttttctaaggtgatcatacttttttctccttgaccatgaacccggggtgactctgttcaaaatgtttgaaacgactggttttgaatttgaagtcaccccaacaaagattagctcagcatcttcatttacatgttccacaccaacaaagatgagctcagcatcttcgtcatctacttgtttggtttcttgtatgttcttctgtggttcaggctctttctcttcctcacatgattgttccattttctaatttttttattcctgaatggtggggccacaagtcccaatgcttcctttatataaactgccacctaagtacaaacatacatcagtaagtacaggaaaatgcattaccttatttaattttcctccaaaacattgtttttataaaccactattttacccacaaggacactgagactgaaagaggataaataacagcttaaaacctgtgataaaagatcaggttcctatgaatctagaatcataactttgctgtactgattgtgctctattccattttaaaaaaaaaacctaccagcagctaatcactaggcaaaattatatggaaaagacacacatttttatgagggcatcattgtgcagtgtttagaaacatgggctttggagttgaagagtaagctggaatccttagtctgccacacaccagatgcttcctctttagcaagttttttacttttaaatgtattttgctatcttaaaggcaaaaattcttatttcttagacttacagtaatagctggttttttaaaagcaccacctattcaatggcagcttgatttgtagtggaattggaagaaaattacaataaatgaaaatatctcaattgattcatatatagtaatctcataaacattaatatagaaaagaggtattaaatttatagagttagagtacctacacataaccaacaaacagcatagcacaatgtcaattgccaggcagataatctcatcccaactcatggccttaattataatccattcagtaatgcctcctaaattttcccctccagttctgacttacccactgaacttaaacacaacagtgcttcctcctcaatctcttctccacatagcaagcagattgattgtgttaaacaaagtcagactgtatcattgttcagctcaaaaccctccaacggctttctgattaactgagagtaaaagaccaagtattaccaatgcctagaagactacactaccaaccccacatactgctcctgcagttatctcatactactctccactatccacttcactgtagtcacactaacctccttgctatttattttaattttttaaattaaattttatttttttgagatggagtcccgctctatcacccaggtatatatttcagctcactgcaacctccaccttccaggttcaagtgattcttgtgcctcagcctcctgagaagctgggactacaggcatgcaccaccacacccagctaatttttgtattttcagtagagatcgggtttcaccatgttgaccaggctggtcttgaattccttatctcaggtgatccacgtgccttggcctcccaaagtgctaggattacaggggtgaggaactgcacctggccctccctgctatttcttgaacatactaagctcttttccttgctcaaagcccttgttccttccaatatgaatgatcatttgggtatccgcatggctagctcctcactgcccttagggctctattccaagtatccctctcggtgaggttcttaaatattccaaccaacctctaacccacattcctaatctcttttcccttttctttcatccccaaagccctatcaccatttaacatattacgatcctatttatcttgattattttctattgtccatccagtggaacataaaactcaaaagggcaggtattctatcttttgttgactgttgtatgcccagcacaaagaacagtgtctggcacaggacaggtgctcaacaaatacagaatttgttaaatgaatcaataaatatcgactctccttcataagatcctttatttttaaagaagattatgctccattaattccacattttctatgaatttactctgagaactttatccattggaaattccgtaggccaataaaggacttaaagctagctttttacaaatatttgaccacaaccaatagtttaaaaaaaaaaaagtgatatggagtccaattacacaagcacatacacataaataataactacctttactacacaggctgcattctaaaattttctatttcatttttcttgtctttttcttttttttttttttttgagacggagtctagctctgtcgcccaggctggaatacagtggcgcaatctcagctcacggcaacctctgcctcccgggttcaagcaagtctcctgactcagcctccagggtagctgggattacaggcacatgccaccacacccagctaatttttgtattttttagtagagacggagtttcactgtgttggccaggctggtcttgaactcctgaccttgtgattcaccagcctcggcctcccaaagtgctgggattacaagcatgagccatggattacaagcctgagctgtgcccagcctcatttttcttaaactaaccacagacccacaaaatcagttaagcctcatcactaggtcactactagttgtttcaaaaactggtctaatgctagcaaaatgtacgcactagaaaccaaggttcataactcaccaatttctaaaaacatatcaagattcactgtatccccatgtggacccttcaaatcagcataatccaaagcataaaaattaaattgacatctaataaatgccatgcacatttgttttaattttaattaggatatcagtatctaattttggaacatatagacaatatttattcctataaatatgtgtatcaccttggaagtgaatttaaaaaggaatacaatattaagtaagcattgtcaactatatacaaactggtgtatcatgaatagtgatttacaacttaattagtagatatataatgccagaaaaaatataaggcagatatgaatacactgctctctggagtcaactaaaattggtttagtctgtctatatacaacttcaatcgcctaactccaggatgatgtcacctagcccagtgtttcctaagcattactgacatttgggactagataattctttgctgggggctgtcgagagcactgtaggatgtttagcagcatctgtgatctctacccactagaaaccagcagtagtcccccagggtggcaactaaaaatggctccaggaattaccaaatgtcctgtgggaaaactcctgcccaaatccaatcttctcaggatcacttccacatttccagtaactaccttctacataattctaaatgtattttctaacatcctctctaaagaaaatatctggccgggcacggtggctcatgcctgtaatctcagcactttgggaggccaaggcagttggatcacaaggttaggaattggagaccagcctggccaacatagtgaaaccctgtctctactaaaaatacaaaaaattagctgggcctggtggtggacacctgtaatcccagctacttgggaggctgaggcaggagaatcgcttgaatccaggaggcggaggttgcagtaagccaagaccacgtcactgcactccagcccgggtgacagtgcgagactgcatctcaaaaaaaaaaaagaaaatattctaattcacaatcattaatattctccaatatcctaaaaaatcagactataatctgacaacatggccattagatttatctgaagattaattagtttattattgttattattttttctttttcaagacggagtcttgctttgtcacccaggctgaagtgcagtggcatgatctcggctcactgcaacctctgcttcccaggttcaagttattctcctgcctcagcctcccgtgtagctgggattacaggtgcgccaccacgcccagctaatttttgtatttttagtagagacggggtttcaccatgatggccaggatggtcttcatctcctgacctcatggtctgcctgccttggcctcccaaagtgctgggattacaggcgtaagccaccatgcccggccaatctgaagattaatttttaaagcccccagaagtttatgatttactaaagttatatggagggtttgtagacagagttagcactaagatgcctaattcctgaattctggttttgtgctctttctgctaaaactgacttagtgcacacttatttctgatgatattgctgttaactgcttagtctttaagaattaaagtgtctcattggattcattttttcactctctattttgtaaacctgttcaaacctcctctacctcccagaaaatgtcaaagtaccttataagccattttaaataacttttagagcatcactcattctacctctcatgtccattcctattaatggcccccagcccaggccgcaacttctaggtttaggtccactggttacttcatttttgtacacttgtactagaccctaaattgttctgtctcttttctctgtccttcaaattatataacacaacaccacaagatggatcttaaaacacaactgtaattatatcactcttctatccctaagcgttaaatgattcctccaattctagagaatattttaggtatacataatttgtgttatgctatgggctgaactgtgttccccccacccccaaatttgtatactgaagctataacccccaatgtgatggtatatagagatggtggctttgggtaataatcaggttaagatgtattcatgaggatagggccctcatgatgtgattggcgcccttataagaggagatatcacagaccttgcttcctctttctgtcatgtgagaacacagcaagaaggctgtcatccaccagccaggaagagagccttcactaaggaaccaaatcgtccagcatcttgatcttgaacttcccagcctaaaaatgtgagaaatgaattcctgttattaataaaccatcaaacaagtaaagaagaaaaacttaaactgggttctaatgacactgctggacttcctaaccagttgctcttggttagatttttggctgttgtccatactgattaaccctccatccaaccatcaatcaaggtgaaaaagaggaatagagcaaggatcaggaacaaagctaataagttaatgaacaagttcattaagaacaagagtagcattagaccatgagagttttcttctcctctagatgtccagagacccttctctacaaatgtccaccaatggatgaatgaatgcttattttccaatttgccagaatcttgagatactggggtagggaggttagacatgcaaagatatatcagatctaacaggtttgtcctcaaaaatcaattctcacctcccatgatgggagaagccaataggagggcttcaattccaaagaaagctgagagatcagtggatgataacccaccttccagattatttctatgcattcaaacaatggcccttctactagatcattgttttttgttttttttgagatggagtcttgctctgtcacccaggctggaatgcagtggcgcaatctcggcccactgcaatctctgcctcccgggttcaagcagttttcctgcctgaggagctgggattacaggtgcgtgccaccacgcctggctaatttttgtatttttagtagagatggggtttcaccatgttggccaggctggtctcaaactcctgaccttgtgatctgcctgcgtcggcctcccaaagtgctgggattacaggcgtgagccaccgtgcccagcctctagtaaaccattgttattaccacacacgagtttttaaccacacacatactcttctgaggaaaggcttccccaaactattggtccttatgatgagatctggccatatatatttttcttctgaaccccaggattgtggggctgtcacatttcctctaacagtacaccttaggagctcccagacttgaagaaaattggctgtttcccacatttgaacattttccactttttccctcagtctacctttttgaattgatttctgactacttctagataacctttttccattaatgaatattgagtgcttattgtgtgccaggcactgctttaggcacttgagagaaatcggtaaacattaacagacagaaatgaacaacaaaaacaaactatttcaacagaaggaactaacaaacagtccagtggaggaagaaagatagtaagtataataaaaatgcaaattctctggtgaactggaagatgacgttatagaattaggaaaaaaataatagagcaggcttagaagttgaggaggtataagagaattgtaattttacgtagtgtagtcagagtaagtctcatggagaaggtaaatttggacatacacttgaaggggataaaaggtcagagaggtagcaagagtggaaatagtagtaaggatctgtaaattcttcatttttctctcagtttagtctgtggcaactgtcatgtcttttgataaggaacgaccttggtttaatagttactcccctcctagactctcaggctagattttttttttttttaattgagacggagtcttgctcttgttgcccaggctggagtgcagtggcacagtcttgtgcacagtcttggctcactgcaaactctgcctcccaggttcaattgattctcttgcctcagcctaccaagtagctgggattacaggcgcccaccaccatgcctggcgaatttttgtatttttagtagagatggagtttcaccatgttggccaggctggtctcgaacccctgacctcaggttatccacccacctcggcctcccaaaatgctgagattacaggcgtgagccactgcgcctggccttttttttttttttttttttaagatggagtctcgctgtgtcacccaggatggagtgcagtggcacaatctcaactcactgcaacttctcctgagatgcttgtgcctcagcctcctgagcagctgggactataggtgtgcgccaccatgcctggttaattttttgtatttttattagagatggggtttccccatgttgtccacactggtctcgaactcctgacctcaagtgatccacccaccttggcctccaaaagtgccgggattacaggcgtgagccactgcacctggcctctcaggctagtttcaaccctattttacactcctctaccatcctcagcttacttttgaaaaagtatttattaaaaaatatttatgaaaaagttatttttgttttatttagttgccctgggatggaatacaaatgtttgctgtagttttaaggatcctataaaactcccatttactgcaaggatctctgtttaatgggcattcaattctaagatagcaaacgtgtagagttatttgtgggggtgggggacaagtttgagaaagaagcagtggggtgaagaaagtgataggcaagggaagatggtggggataggtaccataggagtcctggtggcctaaaatctaatcacagaagttactcaagtgggactgatgcctgaaaaaaatttgtgtgtggctataacagtgagtgggatctactcttttttttttttttttgagatgggagtctcgctctgtcacccaggctggagtgcagtgccgtgatctcggctcactgcaacctccacctcctgggttcaagcaattctcctgtcttggcctcccaagtagctgggactacaggcacatgctaccacgcccatctaatttttgtatttttagtagcgacggggtttgatcatattggtcatgctgctctcaaactcctaacctcaggtgatagacccgccttaggctcccaaagtactggaattacaggcgtgaggcaccgtgcccagcctgggatctactcttaagcaacagagaaaatcagtcatttttccccttttccttcccttcctcctatgagcagaatcttggtctccatctttaaaaaaaaaaaaaaaaaaaaaaaaaggccaggcacagtggctcacacctgtaatcccagcactttgggaggccgaggtaggcagataacctgaggtcaggagttcgagaccagcctgaccaacatggtgaaactccatctctactaaaaacacaaaaatttgccgggagtggtggtgggcgcctgtaatcccagctacttggtaggctgaggcaagagaatcaattgaacccgggaggcggaggttacaaaggagatttgacagggtggcagttcaaactaaaagtggtctgatagttcagagtcaagtttcttcactaaagctgagtttttaaagggcttgaagaatgatgtaaagaggggttgtggaggaccacaaaaaaagacaactaaaaaaaggcataacaaagtcaacttattaaatgcccagcaacagggtgaagttaaggggaatggtggaataaagacctacaaatagctgctgcttcataaaagcaaagagaacactagcaaaaactacaaaaatcacgtttttcagatcctggaaattaacgaaagcttgtaaaactcaaaagattttattacaaaatggcttggcggttcctcaaaatgttaaacatagacttatgatcccacaaatctaagtatacactcaaagaaataaaggtactcaagtacatgtatacatgtttatagcaacaactcataataatcaaaaggtggaaacaacctaaatgtccatcaatggatgaatggataaacaaaccatggtatatacatacaacagaatgtttattcagccataaaagaaacgacatactgatacatgctacaacagggtaaaccctgaaaatataccatgtaaaagaagtcagtgacaaaagctcatatattgtatgatttcatttacaggaaatatcagaaatagataaatccatagatattaaacaaagatttgtggttgccagaagataggaaagggaaaatggtgagaaactgcttaatgggtaaaggggttttactttggaatgatggaaatgtatcagaactagatagaggcagcacacgtacaatattacaaatgcactaaatatcactaaactgtttattttaaaatgactgatgttatgtgactttcacctcaatgaattattttttaaaaataaagagggtatattactaccaaccacacagaaaaaaagagaattataaaggaatactatgaaaaattatctgtcaacaaattagataacctagatgaaacaaattcctagaaagacaggaactaatgaactgactcaagaacaaacagaaaatatgaatggatccaaaacaagcaatagaattagtaatcaaaaaacttccccaaataaaagcccaaaatcagatagctatgctagtaaattcttaacgtttttaaaagaattaacaccaatccttcattaactcttccaaaaattagaagaggagagaaaactttgcacatctttctatgaggctagttattactcttacaccaaaatcaaaccaagaaatcatatataaaaaaagaaaactacaggccaatatcctttttttttttttttttttttttttttttggagacggggtctcgctctgtcgcccaggctggagtgcagtggcgtgatctcggctcactacaagctccgcctcccaggttcaggccattctcctgcctcagcctcccgagtagctgggactacaggagcccgccatcacgcccagctaatttttttgtattttttagtggagacggggtttcactgttttagccaggatggtctcaatctcctgacctcgtgatctgctcgccttggcctcccaaagtgctgggattacaggcgtgagccactgtgcccagccaatatcccttacagaggcaaaaatcctcaacaaaatgttagcaaacaaaatctaacaacatatataacgattacataccatgaccaagtgggatttatttaaaaaatacaaggatggttcattctatgaaaatcaaccaacaataattttatttttattatttttaattttaattttttttttgagtcggaatttcattcttgttgcccaggctggagtgaaatggcacgatcttggctgaccacaacctccgcctcccgggttcaagcaattctcctgcctctgcctcccaagtaggtgggattacaggcatgcgtcaccacgcccagctaatttgtttgtatttttagtagagacatggtttctccatgctggtcaggctggtctcgaactcccgacctcaggtgatccgcctgccttggcctcccaaagtgctgggattacaggcgtgagccaccatgcccagcctataccattttaataaaggacaaaaactacacctgcctgcagaaaaaacacttgacaaaagctaacatccttttatgatttgaaacaacaaaacgattaggaatagaaggaaactttctccaccagacaaaggcatctgtatgagactcacagctattatagtatcatacttaatggtgacactgaaagtacccctgcccctaagatcaggaacaagacagatatccactttaaccacttcaactcaacaccgtactagaggttctatagccaaggtaattaggcaagaaaaggaagcaaaaagcattcagattggaaagcaagaagtaaaaccataatggagatgacaaatacaaataactcaattttttaaaaggccaaagaacttgaatagacatttctccaaagatgatacacaaaagaccaagtaaatatattcagtgtcattaatcataaaagcaatgcacattaaaaccaccttgagataccacctcacacctagtaggatgactactattaaaaaacaaacattgttggaaagaaattagaatcctcatgcacagtcactggattgtaaaatggtataactactatggaaaacagtacagaaatgcctcataaaattaaaaacagaactactatatgttctagcaatcttacttctgggtatatatctaaaataattgaaagcagggtctcgaagagatactggcacacccatgttcacagaaggactattaaaatagccaaggggtagaagcaacccaaatgtctacccaaaaatgaataaacaaaatattatatatatatatgcacacacacacaatagaatattattcaacctcaaaaaggaagaaaatctgtcacatgctacatgtttgaaccttgaggatattatgccaaataaaataaaccagtcacaaaaagacaaatacttttgtatttgtataattccacctatatgaggtaactaaaatagtcaaattcatagaaacagaaagtagaggccggaagcagtggctcacacctgtaatcccaggactttgggaggctgaggtgggcagatcatctgaggtcaggagttcgagatcagcttggccaacatggcaaaaccctgtctctactaaaaaaaatacaaaaattagccagatgtggtggcaggcacctataaacccagctacttgggaggctgaggcaggagaattgcttgaacccaggaggcggaggttgcagtgagctaagatcacgccactgcactccagcctaggcgacaagagagaaactctgtttcaaaaaaaattagctgggcgtagtggtggcacacacctgtagtcccagctactcgggaagctgaggcagaagaatcccctgaatctgggaggcagaagttgcagtgagtggagatcgcaccactgcactccagcctgggcaacacaccaagactccgtctcaaaaaaaaaaaaaacaaaaaacaaaaaacaaaaaaccaaaaaaacaaaaaacagaaggtagagtaatggttaccaagggctaggggcagaggaaaagggtgagtctgttgtttaatgggcattgtttcagttctgcaagatgaaaaagttctagagatctgtttcacatcaatgcttgaaactactgaactattaatttagaaatggttaaggtggtaaattatatgcgtttttaccacaataaaacaattcattttaaaaacaggccccaatcggcatggtggctcacgtctataatcccagcactctgggaggccaaggtgggagaatcacttacagtcaggagtttgagaccagcctggccaacatagcaaaaccctgtctctactaaaaatacaaaaattagccggcatggtggcacgcgcctgtaatcgcagctactcgagaggctgaggcaggaagaatcacttgaatccaggaggcagaggttacagtgagccgagatcatgccaccacactccagcctgggcgacagagtgagactctgttaaaaaaataaaataaaataaaaaataaaaaataagctagacacagtggctcacgcctgtaatcccaacactttggaaggctgagatgggaggatcgcttgagcccaagagttgaagatcagtccaagcaatgtagtgagaccccttctctacaaaaaatttaaaaacacaggcacagtggctcatacctgtaatcccagtattttgggaggctgaggcaggaggacttagtcagctcaggaattccagaccagcttgtacaacatagtgagaccctacctctacaaaaaattaaaaaattaaccgggcgtggtagagtgtgcccgtgatcacatcactgcactacaaccttggtgccagagcaagactgtctcaagaaaaaaaaaaaatttaaatttagctgggcatcatggcacacgcctgtagtcccagctactcaggggtggaatgaggcagggtggcagctgagatgggaggatcactggagcctgggaggtcgatgttgcagtgggccataattgtgtcactgtactgcagcctgggcaacagagcgagaccctgtctcaaaaacaaacaataaaaaatgggcgaaggatttgaacacttctccaaagatacacaaatggccaagcagcacatgaaatgctgctcaatatagtcattaaggaaatgcaaatcaaaatcacaatgagctattacttcacatccactaggttagttataagcaaaaacaatctcaagcgttgcagaggatgtgcagctatctgaaccctcaaatactgctggtgataatataaacttgtactttggaaaagtttggcaattgctcaaaatttaaatatggcgttaccatatgacccaacaatatcactcctaggtatatacccaagagaattgaaaatataacacatatataagctagctggaatatagccataatgctgctacaaagtgcaaacaaccgaatgtaaattaattgataaatgaataaacgaactgtggtatatccgtacaatgaaatactattcagccataaaaaaactaagtacaaacaagcatacaatacggtgtaccttgaaaatacactaagtgaataacaccagacacaaaaggccgcatattttattattttacttatacaaaatgtccagaataaggcaaattcatacagacagaaataaagtagcagctgccatgggctcgatgaagaagaatgaaaggaatatagcaggtttgaaaaatggcccccaaaatatcaggtcctaatcccttaagcctgtaaatgataccttatttggaaaaaggatctttgcagatgggaaaattatcctggactatacaggtgggccctaaatgccaccacaaatgtccttgtaagagaagcagagggagatttcacacatactctaggaaaaggtgatgtgaagacagaagcaaagattagagtgacatggtcacaagccaaagaacgtcacatccacaaactagaagatgcaaagaatggattctccgctagagtttcccaggggaggacagccctgccaacatcttgatttaggtcttgtgaaacttattttagacttctgacctcccgaactaagggagaataaatttttgttgttttatgccaccaagtttgtgataatttgttatagcagctatggaaaagtaatatagggagtgactgctaatggatacaaggtttctttagagttgatgaaatgtcttggaattagatattgctgatggttgtacaattttgtaagtatataatactaaaaaccattcaatttcacaccgcaaagggtgaattttatggcatatgaactatatttcaaagaaaaacaaatgcctagtaacaggctggtataacccgccatctcccaacaactgctgctaaattttcaaagcaccattaagcagactcaattcgtagcaaggataatggaacaatgcaagctcatctagcgaacaaaaagaattaagctagtatcaggtggtcaatttacaaactgtagtgggagtcatacattcccaaggatggaacagttatatctccttgcagagtgaactcttctccgataccaaggacttggaagaccaaataaattatacgtaggattaccaaatatgctggtatgaccaagacagttatagtttaaacttctatctctgtggaattatggatagtgccactcttcaatctttaataagtccttcagtttagatgataaattacatagtcaacctagttataaggaatctagaggttgtgaaaagctgtgagagcatattctatgcagaccacataggtcctatcatgactccctatgtaacttgggtctctgcgactgggaagctcccagggaaaaaaccccagttaagacttctgcagagcattcacattttgtttcaaacttatacaacactaatgctaaagctcaactctcagaattgtattattcagtattatccaaataactgattaatttacacactgaagggaaagaacaaggaatggacctatacacacttgtagtttacaagtataagaagctaacaaagaataagattaaaataacttgtgccaggccgggcatggtggctcacgcctgtaatcccagcactttgggaggctgaggcaggtggctcacgaggccaggagtttcagaccagcctgaacaacatggtgaaaccccatctctactaaaaatacaaaaacttagctgagcgtggtggcacacgcctgtaatcccagctactcaggaggcaggagaattgcttgaacccgggaggcagaggttgcagtgagctgagattgtgccactgcactccggcctggacaacacagcaagactccgtctgaaaaaaaaaaaaaaaaaaaaacaaacaacttgtgcccacattaactaggtgttaaaagccaaaaggtgaaagtcactattctcttttcacatatcaaattgaccctaaggtaatattgctgcattagaactgagctggtgggagggatgttaagaaattagggagaaattgttaatctacagaaagaccatcatataaggttctgtgtgtagccaaacatacacatttgatgttctgatgtttgctattttagtggaactatagctataaaatgtattcaatcagtagaattaaaacatatcccagtccacaaaaaactaagagagaaattatacaggaatgatcaagaatctgcacagttctcataatctcattactagagagaaaaggagaaagggaagcatcaaggtagtatttgagacgaatttaagaagaccactcattcaataaaagtttggtgggccaacaaggtgccatgtattggtctggtgatatagcagtgatccaaagtctttcacttcagggagctgacattccagaaggagtagtcagaaaataatttttttaacaaaagtaacatggttatataaacactagggagaaaaataaagtaggaaatggaggcaggttgatactcacataacatgaatatggctgtctggggaagaatactccaacaaagggaacagcaaacacaaagcctctgagactggagcacttaacacatgcaaggactgatcaataggctaacacaggtggaccaatgaaaagagtgacaagttagaaatgagataaaaaatgagctgtttgtggcaaaggaaagccaagatcatgtaggccattctaaattcttcagctttggccaggtgtggtggctcacatctgtaatcccaacactttgggaggccgaggcgggtggatcacctgaggtcagaagttcgagaccggcctggccaacatggtgaaaccccatctctactaaaaatacaaaacgtagccaagtgtgctggcatgtgcctgtagtcccagctactcgggaggctgaggcaggagaattgcttgaacccagaagacagaggctgcggtgtgctgagatcatgccactgcactccagcctgggtggcagagcaagactccatctcaaaaaaataaataaaaataaaaataaaaataaaataataataatacaaaaattagctgggtgtggtggcgggcacctgtaatcccagctacttgggaggctgaggaggagaatcacttgaacccaggaagcagaggttgcagtgagccgagactgcgccattgcactccagcctgggtgacagagcgaaactccatctcaaaaaataagtacataaatagacaaaaaataaaaacaaattcttcagcttttaccctgagtgtgatgagagattactggaaggctctgagtgagaagtaatatgatctcactcatttcattaggattgctgtggttactgtgtggagaatagactttagagagtaatagtggaagcagaagacaagaagctactgaaatattataaacaaaagatgatggtagtatcagacaggatggagaaatagagatactaagaagtcggactctagataaaaatctagaaggcccaattcattgatggattgggtttgggatgtgaaggagaggaggaggacacacaagaggtaatgctgagcaggtaaatctatgagatcagagcccaaggaaagttccgaggtaggtacttaaattttgaagtcttcagtatgtagcattatttaaaacacaagactggatgagatcactcagggaaaagaggtctgagatctaagctctggggcattccattgattagaggtcatggagatgagaaggagctggtaaaggaaattaaaaaaaaaacaattattcacagccattcaggtgggaggagaattgagaaagagaagcatcccagaatccaatggggaggagaaaaggaactgtaatatatgctgccaatagatcaaataaaatcacgaaaatcaactaaaactgaccaatggattaagcaaagtggaattcattggtgaccttgacagcagtgggtttaaggaagaacgagaacaggagatagcaaatacggacaactctggagaaattttcctgtaaggacaagcaaatacaaattaaaacaagcagatgggagatgtggcatcaaaaacgagatctttaaggtgaggtgatggtacaatcagtatgtttgctatattaatgatctggagagatagaaaacttaaccctagacaaagagaagtcttgctagaataatatccttaaataaacaagtgcacatgtagaggttctggccttagcaagaagtcaaattattcacccagagtaacaggacaatgctttgagatcctatggaaaagggttaaatggtggataaatggttgcggtggccatcctccaagatggccctaaatgaatcccacttcctggaattcacatagttgtagccctctcccactaacagggttggcctgtgggatcaagcacatacagcaggaagtgatggtatgccacttcagaaattaggtcataaagactctgcccttcatcttgggtacaaggtctcttgaatcatttgctctgaagtaagccagctgctgtgacatgaacagccccatggagaggcccacagagcaaggaactgaggcctcttgccaacagcccagtgagtgagcttagaggcagatgatccaaaccaagtcaattccgcagagactgacaatccagccaaaggtttcactgaaacctcatgagtgaccttgagccagaaacagccagctaagccactcttggattccagaccttcaaaaactatgaggtaataaatttttttttaaactactaagttttgagacaatttgttacacggcaatagataactaatacaatgggtctcactgagctgtaatcacaaattgctgggcacacaattcactataatctcacctactggcatgcaatgacttcagatgacctcccctgtcctgctgcatgcagttacctcatgaaatacagtcgctgagaaagagggtaggataaaaggagtcagctttatataacttaacatccctgatgctcttttttttttttcaagagatgtggtaaaagaatgccactaccaccctctcctttctcaacaaagcaatttagagggttcccgaatgacctacatcaacaattggcctgaactaatcaaacgcatcattcagattccctcagtaaaatattgaataccaaacagctatgcttcagcaaaggaaagggcaagggagcgaaactgaaggacgaaaatacaactttggtcctcatcagggagacttctcttttcttacctcaggtttattacaacgcaacttttaagaacttgagctattccaggcagaaggtcacatccttgaggtaaccagagagaagcattagttacttacatgtcacaagaatattttcgatcccactgcctgacattgccatttaggtgtttatcaatcatctcacacttaaccagataagtgaactgaactcctttcccccagatctgttcctccaatctaccctaccttagcaaaggaaaacgtcccacccgccaactgcccaaatcaaaagcctgcaaatcacccgaggtcctggctctcacgggagggactccattagggtcccaggggctgcattaagagtcccgacagcgacgcagtaaatgagacaagacgctgcggtaggggagagagacccatacattcaaatgccttaaggggtctgggcctacaggtctccagaactggggagggcctggggttacaaagcagttttcagatttttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctccggcagcgcacggccaagcgcggtgtcgcgacccgcagggctgcggctcgccatgaaatccctcaagtctcccctcagggaacgctgaagccgcgccacgcccccgtccttaccagtccggatcagctgctgttcgcgagctgccggccacgcaccagccccggaggcgctcccggggcacagccggcggcgactacgcctcctcaggcccccggcgccgccgacgcgcacgcctccacacgcgcgcgtccagtggagacctgcgattggctgccaggtgccggcgcgagatcggcgcggctccgagctaggagcatgcgcgcgctctgacgcccctggtggcgacggctggacgcggggttaaattgagaaggaggagggcagcagcaatacccctgaggccttgaaaggatcttgggttccggatcacggttccaggcagtcagggttccagagctgagggggtatccaagcagtcagggttccagagctgaggagcatccaggcagtcagggttccagagctgaggggcacccaggcagtcagggttccagagctgtcgcagccagggcttggggtggggggtaggcttccagtccatcaggggatggtttgcccaccagaaggccagctgttataatt

SEQ ID NO: 2496 - DNA, 11429 bp, Homo sapiens
gtgcttcacattgcttctctttattttcaacagtttctttacaacagtctacacagggattaactcctacatgtacttcccaagccagaatctccctttagaaattcagattctatttctaactctataagatgtatctccccaaagatcacattaactcctcaagtcaacatctgcctatccccaacttcccctttttttcctcactgaacatttgtctgaatgttttttcctcactgaacatgttttcctcactcacactgaacatttgtctgaaactgtggctgctttgttgcttcaagatgcatgcacatcctggctttagtgtccaagtatgcagaatgaagcatttgatatgtgcacccagctagttaggcatgaaacaggggcacaggatgggctccgggtcatagaaggttctgtccccacagtgaggacaggggttggcactaagccagaccatgctgggccgccccaactcacacagcaactccctgagcctggcatgcagataggcaagcctctccaggtggagggtaccatggatgtcctcataactctccagggggacaggatacagcacgtgggtcagattgctcagcccgatgaggtgctgcaggagactctgcaaggcagatatggagatggaattcccgtagaagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaagcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaaggaaaggcatcagtgaattttagtatttgaagatacaactgaaaatactttctttcaactcgggcttccttctgccactgcctgggccccagtcacctctatctctgtgcctgatgaagctactagggagtattcacagtggacaaactggggcaaggtcagcaacatccaaagggggttcccaggctgcagggctaccttaggtcactgtatcatcagcaaaccacctatcaatttttgcaatttctctgttgttccttctcccacatctccagaatcctgcatttcccacctattaccctaactggaattctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgataccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggctgagctgcttctggctctggaaatgagtacagactggccctgtttccagaccatacagtccagaagtcctgatgagagttcttccgtaaatccagcacttgaagtttccacctcctgtggggaaaaacaggtaattagctgagatgatgctttaagatcaactcaaaataagaccatgagtctcataatgtaggtaagaaccaaacagacatccaccttagatctgcacttttacttcgtacttcaggcatcagctgctccctttcccactaggatcctgggatccttcctggtccccaattcccaccccaccaggaggaagcaggtgcatgttccttcagacacctctgcattttaatcagtgccccatgtccagaagcccattccaagagtgacccctgcagtagccccaaggcctccctgaacttccttgctggcaaccatcagagcctctggcccagccttaggcgctccatgctccctgaccccagctgcatcctgctcaggttcccagggccccacaccaagctgctaggtcacccttacctggggcgaacctcctgggcaaggagcacatcaagtccatcaagcacagctttgaaggtctccaggtgaagatgttgtcccttcatcagcactcccagagggaggcaggtgaagggccaggcctgcaccattgccttcagggtctggctgtgtctcccgtcaaaggctgccatgaagagtggcgggaagagctccctgggcagcaactccagggcggcaatggccagggcctcatccttcagcaggctctgccctgccagctccacaagtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcttgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatcttgtatactagatatcttgaaaaagcctccaccctccagcacagtggctcatgtctgtaatcccagcattttgggaggccagggtgggagaatggtttgagcccaggagttcaagaccagcctgggcaacacaaggagacctcatctctattaaaaaaaaaaaaaagaaaaaaaagaaagaaaatgtctttaattccaaagcatctgaaaagaaaaagaaaaaaatctatggaatattttttaaccttttagttaaaatggaatattttttaaccttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacatactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccagacctctgggaagaccacaacattgactccatggcctctgggtccctcctctggcccctctgaagctattacaggcctttctgggcatacctcccctttcaactccacgctgccaacggaagagccaaatctaattacattcctggatctccagccagtgaatcctgatggggttttttacttacttcaggttcaactgattgaatgggatgtctatttacaaaaaggaaagaaaaagtgaacaaaaccacccagagagtataactgttaggggaatttttggccacatcaaaattacccaaatagtccagttaagatagctttatgaagagcatcatgacatcaccccttcccactcccaaacaatccccaagtatcaaattgtcacttataccccatgttccctaacacagcaaatcacatgcctatccaaggaaaaagggaggaacaacagaggggtggctggtcttccagactttgaaagtcaaggctgtcctgaaggaaggtgggtcaaaattacactacaattaggagttagtcagaagtaaggctgggcatttgtaatgggactgagtggattaccacaaagacagataggtttttttgggggcggaattgaaagactttggcctggatggagtagagaaattaaaaaggggaatggctaaggaagatgaaagatagttccagtaaagccaaggtaatcactgaggcagggagggagttcaatcttcctccctccctagagggaaagggtgttttctcccagaaagtcaggatcctcttggcaaacagccttgacaagattaaatctaggaatgtgggctggagaggtgggatagagagtaatattggtgaccaaacctaggacagcaacattttcaagtctgaaagaccttgtggtttcttaggaatcttggagccaggaaagaaataaacaagggctgaaagcacacatccctgcaattaaagaagttgtcagaagaccttctctttatggttaggtgtcctcttccacactggggctgttcacaagcagcaggtcaggcctttaccacaaacataatctccaatggccagccccttcctaagtattactaatgtttccacacttcaagaaaacagctgttctttcttgcccctaagctgctcaggtacagagattctggtcagcgagatgcaatcaggcctatcaattagactcagtttttctctatttccatgctaggcacagtgcacaaatacattttccgtcacaaaaaattgaagttatatttggcatttaaggatctgcttagggatgattcctatcctgggcctgatcacccactggtgcttttgaagttttggaacctctccacccaaagaattctccaggccattctctgcctcatgcactgtgaagtccctacaattcttatattctactggcaagtgtccagctggaatgtcttgcggcctgactttgtttactgtggcctgcgtaaggaggctgtaattcgttgaaggatgttttccattttggttctctctctggagactttctcctacttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctactggttcttatggtccttgtgggctgcacaggccagagtggcctctgagctcatcaggtgggtggtctgcaccctcctctctagtcatagaatcccagtggggacccccgaagtatctgcaccaggtccttcaggtgttttttttggagtgcagtggcgcaatcttggctcactgcaacctctgcctcctgggttcaaacgattctcctgcctcagcctcccaagtagctaggattacaagcacacgcccccacacacggctatatttttgtatttttagtagagatggggtttcaccatgttggccaggctggtctcaaactcctgacctcaagtgatctgcctgtctaggcctcccaaagtgttgagattacaagagtgagccaccatgcccagcctctttttcttttttagagacagggtcttactatgtttcccagactggtcttgaactcctgggctcaagtgatccacccatttcagcctcccaaagtgctgggattacaggcttgtggataccaacagcacccgagcacggtcccacagtccaacgcactgtgccgtccttgagcctttagttccagcacaagtctcccggcttcaacccaggttgcatgttctccctgatctccccaggtggcacccaaggatgaggcagtgcaatcttgttgctcacttcccaggaccgacacttacccctaatggcccaagcccatggggcagtgagatcaaagcctcctggagctcatactctctgacaccactggaagtgtgggcttttgcgtctgattaccccggggaaaggttctgaatgtaatcgtggctttggcaataaggtccacaatgcattaagatttttttttttttttggaggaggagtttcactcttgttgcccaggctagagtgcactggcaccatcttggctcactgcaacctccacctcctgggttcaagcgattctcctgctcctgtctcagcctcccaagtagctgggactacagatgtgggccaccacgcccagctaattttttttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcaaatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagagagttcaccacaccgcgaagttgctggaaggaaagaacgagacaatggctcagctaagcgccctagccgctgcgtggggcggggggggcggcggtgggggccggggggctgggcagcctggtctgaccaatccccgtttctcagtccttccagggcaaaatctcacgagatccagtgaggtcgcccagagagtcgagaggggcttgttttcaaagactgggaggaggaggggcagtgggggaggggcagtggggggaggagcagaggagaagggagcaggaggaggggaaaaggggagaggaagttggagagcagaggaggctgggggtggggagcagatgggggtggggaaggaggggagatgggggtggggaaggggggcgggaggagggttaggaatgggggaaggaagacagggtgggggaggggtgggcatgggggaaggaagacagggtgggggaggggtgggcatggggaaagggagacagggtgggggaggggtgggcatgggggaagggagacagggtgggggaggggtgggcatgcgggaagggagacagggtggggaaccgagaagaaagacagtggggggggatggaggaaggaacacagggtggggtggggggtcgggatgggggaagggaaacaaagagtggtggaggcgtggggattaggaacggagacagagggtgggggaggggtggggtgggggaagggagacagggtgggggaggggtgaggatggcggaaggtagacaaggcgggggaggggtggggatgggggaagggagacagaagggggggaggggtggggatgggggaagggagacagaaggcgggccagggcgggaatgggggaagggaaacagggtgggggtggggatgagagaagacagaggttgggggaggggtggggatgtgtaagaaaaacaaagggttggggagggggagggaaaagaggcagagagtgggggagggggtggggatgtggaaagaaagtcagaaggtggggggtgaggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcgactccccgtgtttccactctccacagaaatccacgcattcacgcccctcccctcccccgagcctgcagaggactccgccctgctttccctacatt

SEQ ID NO: 2497 - DNA, 11429 bp, Homo sapiens; identical to SEQ ID NO: 2496

SEQ ID NO: 2498 - DNA, 11575 bp, Homo sapiens; identical to SEQ ID NO: 2493

SEQ ID NO: 2499 - DNA, 11575 bp, Homo sapiens; identical to SEQ ID NO: 2493

SEQ ID NO: 2500 - DNA, 1588 bp, Homo sapiens
ggccagctctggggtctcggcaggtggtccacaacatgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcaggtgctgtctgacctggctgggcggtagctttggctccaaggtccgctccccggtcagcgagatcctgttcaatgatgaaatggatgacttcagctctcccaacatcaccaacgagtttggggtgcccccctcacctgccaatttcatccagccaggtatggggtggaggtctggggatgggggactggggtggagaggggcgggtgtcctgggcaggcagctgacgggcatccctgtcttctcccatcggccacagggaagcagccgctctcgtcaatgtgcccgacgatcatggtgggccaggacggccaggtccggatggtggtgggagctgctgggggcacacagatcaccacagccactgcactgatatgtgtcaccccttttctccctggccgtgcccaccctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggtgggccgggggttggagaaactgagtcacggtgtggggccccagggcatcctgggctggaggcctggatcatcacagagtggacaattgttggtgtcctctctctagtgcctgggccatctggagcccctgtgccatgagggccaagccccctgctccagtgagacccagcaggccccaacctgctcttcctgatgacctggcccgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtc

SEQ ID NO: 2501 - DNA, 12986 bp, Homo sapiens
tgtgtctaaacaccacgccccacccccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagacgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcacatagggagcaggtctcctgtgttatggcccaagcagggctgttaggacactgagaacattccctcctcccgcaggagagagaggtccaaggtgccctacatcgtgcgccagtgtgtggaggagatcgagcgccgaggcatggaggaggtgggcatctaccgcatgtctggggtggccacggacatccaggcactgaaggcaggcttcaacgtcagtgagtgtcggcctgcgcaggacgggatggaggtgtgggcagtggtgtccgcgatgagatctcagagtgctccatggcccaggcatgtcacatccttctctgtgtcttttcttcatttactgttttattattttaaaaaaagagaaaacaagagttgtacaaacagcttctatagaagccagtttttacaccatcgtacccactcatgccacttggtggagtggaccaggggcttctgtggggacttggccttcctgccttgggggtggacaggaggtggaagcccaggactcagtgcggtctgtccactgccctgtatgaggatgtggtgggcagagggcactgatgaaattcagcgcaggccggggctgcagcatctccgcctccatctcaccaaccctcacaggctttgaaggacccagactggcctcaaatgccaggggagggcactgagaccccagagggtccctcccagcatcttcaaagcaacaggattttgtgcctgcaggcccttctttgcagcacacaccacccaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccatgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagtgtggcagggacggtgctttagccaaggcagggatggcgggtgactcactcaggatcttcaaggaggccgctgcatttccatgctctttccagataacaaggacgtgtcggtgatgatgagcgagatggacgtgaacgccatcgcaggcatgctgaagctgtacttccgtgagctgcccgagccccttttcactgacgagttctaccccaacttcacagagggcatcggtgagcactggaggccttggcctcgtgggagatgtctcccccatgtgcactgctgccctcggaggctgtgaaaagcgaggtgtgggaacctgagttgtaacccctctgccatggtcggcattttaacccaacctcaaaaagcaggggaccagaaccgagcctgtcctggaaggccttgcccatccccagagggctccccatccctattcctcaaggaggccaagtgggtgaaatggtcagcactgccgtgctgtggggtcctaaagtctgctgtcctccttcctgcagaccagggctaaacactggtgcccaggtgctcttgccatgggtcctggtccagccaagcatggtttcaaacatgacctgacccttagtcaacctggaggctgatgtctagagtgggcgctggagcgtgcagcacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgtccctcactccgctgtttcattccatgctgagcctcccctgccttgggctccctggggagggggtggtggcaggagttgcccaagggctgctctgcccatgagcagctgctctagcggctcctcctgctgctgttcgccaggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtcccgggcgctccatgtgaccacctcgggagaggtctccggcttgtcgtaacccaggggagtgacccactgcctcctgcagctctttcagacccagttgcaaagaagagctgcatgctcaacctgctgtcgtccctgccggaggccaacctgctcaccttccttttccttctagaccacctggaaaggtagcccagctctcttgtggctgcccaggactccaggtctccaggccgttggggtgcccctctgctcccaccagacccccagcaccaaggaccttttcccccgacccctgtctgcagtaactcactgcttctaaggactagcaccactgccacccctgcccctgcctctcctctttgccacccgcctccctctgcactgtggccttaacaaagagctcagagctttggccgtggccagcagtgcatttggaccgcccccacttccctcccaagcacatcatgaagacctccccatcagcccagagctggccccttgtcccgggccactgagacccagaagtaccaaggctggagtcagcttgcagcacagccagggtcgaggtcactccctccctgaggactctagcatggcacagcccctctgcctctctcctggtggtggcgttgaaacagcaccctctgcttcggtcctctacagggtggcagagaaggaggcagtcaataagatgtccctgcacaaccttggcacggtgtttggccccacgctgctctggccctccgagaaggagagcaagctccctgccaaccccagccagcccatcaccatgactgacagcaggtccttggaggtcatgtcccaggtatgggaagacagcctccagcccatgcaaccccagcctgacagaggtggcctctgcctgccccacccccagtcctgcccatcttcccacttgcattgtatgtggtggtggctgagattcagagagagggacttgcctaggtttgcatggatgggagtgatagggggtgcccaggccacctcctggtcctgctggtgcatcttgctgggggcttaaaaccaccccaagtgttcgggtgtggtggctcatgcctgtaatcccagcactttgggaggccaaggcaggacaaccgaacccaggtgtttgagatcagtctgggcaatgcagcaaaccccatctccagaaaaaatagaaagaaaaattagtcaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttgggggcttgggccccaaagacctccccaccagcagctgtgagcccccctctgagccactctcctcttccccactctgcgagggcaggtcgaggtgctgctgtacttcttgcggctggaggccatccctgccctggacagcaagagacagagcatcctgttctccaccgatgtctaaaggtcccagtccatctcctggaggcggacagatggcctggaaacctctggctaatcgggccatctgtagagtgggaatcaagattttctgaggcatccttgggccacccccaggtgtcaggccatctgccaagagacagtggcccaaagcagaaggacaggtggcctgggcagatcccgcccaggtctgaaagccccaggctggcctcagactgtgggttttttatgtggccacccgagggcgccccaagccagttcatcttggagtccaggcctggccctgggagacagggtgaaagcagtggtttttatgaacttaacttatagagtctaaaagatttctactgaatcacttgtcaagaagcgccctctctggggagaagggaacgtgaccggattccctcactgttgtatcttgaataaatgctgctgcttcatcctgtgggggccgtggccctgtccctgtgtgggtggggcctcttccatttccctgacttagaaaccacactccacttagaacagggtttgagaggcttagtcagcactgggtagcgttttgactccattcttggcttgcttctttttctttccagaaggatttttgtgcagaaatgggtcttttgttgccgtgttagtcctccttggaaagcagctcagaaggcccgtgaaatgtcgggggacaggacccccagggagggaatcccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatgcttgaatatttttaagttttatacatagtttctaatttttttcccagcagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacagctgcgggggagcccaggcattctttgtaagccctcctgactacctgactcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctccccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccgcagctcactggggagcctgacagtggggccatgcgcctgacactcctctctgcttgtggacctggcaaggcagggagcagaaaacagagccccttgaaggcttcctgtctgcgtctgtgtgcagtgtggatttagttgtgctttttacttgctgggagagcacagccaccatttacaagcagtgtcaccctcgtgggtggcgaggacagaacaggagcctctgctctctgtacctatctgggcccggtgggctcccttgtcctggcttccatctctgtctcagcgaccattcagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcaaaggcctagatgccagtgtgacctcccacaaggcgtggcttccagactccccggccggaagtgatccttttttgccgcgggccctgagtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaaccccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacgtggaggattcctgccacacagcctgggcccggtttcttacctgtggccaccgctctggcacgagcccctcagtcttgggtggtttctgcctggtccgggatttggtgttcctgctgagtccagcctttctgccacctccgcatgggccgtgggtggtgttgtcagctgcctcccaccttggcttcagtagctcacccagctcacaggggagctgccctgggctggagatgggcatgcaccctgggtcctacttgaatgaatgcagcttgaggagagccggccatatacactgggccacaggttaccctcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcccctgcctgcagtgtgacccttctcagcttctctcagcagccctgcctgcggagtgtcaccgccaccatgatcatttccctgacactgcgagggtgtggggacgtcctgggtagagacagggcccgtggcagcagcaggctcaggggcgccctacactggtgggctggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcaggtgaggaaagggctgccgctggcccgtttctgagtgttcagcacctaaggatgacagcactgtctgtccctaccctccgggtcctgtttgaaaatcaaacccatgctcacaggccaatttttttttcttttagagacagggtctcactttgtcacccaagctggagtgcagtggtgcgattatagctcaatgcagcctccaattcccggactcaagggaccttcctgcctcagcctgccaagtagcttggactatagctgtgtgttttcttattattttgtagacatggggtctggctatgttgtccaggctattctcaaaattcccggcctcaagcaatcctcccgcctcggcctctcaaaggttgggattacaggtgtgaggcaaggcacccagctcagccacagagccctattgcatctctcttactaggagcaagagctgactgccccctcatccccattccagagtgttggggctgtgttcagccgaggccgggccactggcatggcccagggagcgggatcattcactgctgccccaaatctgagatcattccaccttgacaagacttcctcatccaatccctttacttgacagctggggaaaccaatgcgcacagagcacccccagctcactcggggtctcagagctgatccatgagcggaggctgagatcctgggatcttgtcccccagcctccctgcaaccttaatcccgttctgctgaaagagatggggccggacctcgaccagcagccctggcctggacatgactgtgctcatgcaggtattgaggccgagatgccccggcatcatatgtttttctattttcttttttttttttttgagacggtgtctcactctgtcacccaagctggagtgcagtggcatgatattggctcactgcaacctctgcctcccggttaaagtgattctcctgcctcagccttccaagtagctgggcctacaggcttgtaccaccacacctgactaatttgtgcatttttactagagacggggtttccccatgttggccaggctcgtgtcgaactcctgacctcaagtgatccacctgccttggcctcccaaagtgccaggattacaggcatgagccatggcgtcacttaaatgtagtgagaggccgggcacagtggctcatgcctgtaatcccagtactttgagaggacgaggctgtcagatcacctaaggtcaggagttcgagaccagcctggccaacatggtgaaaccgtgtctctaaaaaaaaatagaaaaaaatagccctgcatggtggtgagtacctgtagtcccagttactcaggaggctgaggcatgagaatcgcttaaacctcggaggcggaggctgcagtgagctgagatggcgccactgcactccagcctgggtgacagagcaagactttgtctctaaataattaaataaataaatatggctgagcatggtgccttaggcctgtaatcccaacactttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcacttgaaactggaagtcagaggttgcagggagccgagattgcaccactgcactctagcctgggcgatggagaaagactccatctcaaataaataaattaataaatacagagcaagattccatcttaaataaataaataaataaacatacacctgtaatcctagcagttcgggaggctaagacaggtcgatcacctgaggtcaggagttcgagaccagcctgaccaatatggcaaaactccatctctactaaaaatacaaaaattagccaggcgttttgatgtgtgcctgtagtcccagctacttgggaggctgagacaggagaattgcttgaacccaagaggtggaggttgcagtgagccgagatctcggctgcacttcagcctgggtgacagagtgagactgtctcaaaaggaataaaaaaaatacaaaataaaaaaaatgtagtaagatggcagagtcgtgccgcggaagcgtgctggtcctatccatgtagtgaaggctgatttcatacagaaatgtcacaagaactttttttctttttctttttttttgagacggagtctcgctctgtcacccaggctggagtgcagtggcgcgatctcagctcactgcaagctctgcctcccgggtttatgccgttctcctgcctcagcctcccaagtagctgggactacaggcctgtgcagcagatgcaggggggccactaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggcctggtcctcaacctgcagtgcactgttgatgcactggaatgccgcctccttctcccagtccaggtcttcagcagtgacccggtaccccagctctaagggaggtggcagcatcaaaggctcccctcgcctgcgtggcagcaggggaaacttgcatctacggggcctagaggcctgggatatgggggagccacccctgggagcgagtgtctgccctggtgctgtatctgccgtcttttcacactgggtgtgacccgaagagacagcctgaggtccgtcctcactcactgtgtttgaggaactgagggtcagctggcagtgggatgaggctggcccctcttccactttcgttccgggaggcctcccgtagagctgtaggggctcgagatggcatttcatttggggcacgagctggtccgggaggtctgcgatctctggttctgacctctgggcacctgctgcagctgtggctgaggcccagaaatgtgaagggcctccatccactccagtagtgaccccaacgtggggttcaatgcggaggggggaggggctgctgcggcagctgcaggagcagaagtgccacgccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacctctgcagcagatgctaagggggccagtaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggccttgtcctcaacttgcagtgcactgttgatgcgctggaatgccgcctccttctcccggtcaaggtcttcaacagtgacccggtaccccagctctaagggaggtggcagcatcaaaggctcccctcgcctgcatggcagcaggggaaacttgtgtgtactgggcctagaggcctcggatgtggaggagtcattcctgagggtgagtgtctgccctggtgctatatctgctgccttttcacactgggtgtgacctgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcaggagctcgtccaggaggtctgggatgtctggttatatctgatttctgacctctgggcatggaggtctgtctgcagaggcccgggcccgggcacaaagggagagaggcctccattgtcccgcaggggccgaaatgcagacggtgcatccccggtgacctccgggacccttctctgatcaccaggattctcttggactctagggtccttgtcctgctcaggcatccctgccccgctctccttgagggccctcaacactatcttccctggacacaagtctggggacagccgggtgttgtggaccccaaaggggtgactcccggctcctgggccccacagagagtccatgttctcagtgcagtggctgagctggaggacgccctggaactcggagcacacagcactggcttgctgtggtacctgtgcaatcaaattgaaggcaggatcccaggaaggaacgcagcgcttgcaggatcaccgaaaaccttcttagagttgtcttgacaccactgatgtcaagtgtctgggtacttgtaggatggcctgccactcagtgcacgggcaggagcaacggggagatcccacaggcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagttt

SEQ ID NO: 2502 - DNA, 97 bp, Homo sapiens
ccagtgctggggtctcaggaggcagcgctctcaggacgtcaccaccatggcctgggctctgctcctcctcaccctcctcactcagggcacaggtgat

SEQ ID NO: 2503 - DNA, 8055 bp, Homo sapiens
cagccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtaaggggcaagagattccaggggatgtgggggtcctgcagcagagctgggaaagggtgaccaaggggagacaagccagaggagtgaggaggaaggttaacccctaagaggggcctgggctgacactggctttagtaatgggttgatattttgtccatcacagatttgtttgaattactgtttttaatatcatattacgatattatttttcttgatttctgagttttctggcgccacttaaattttcaccagggtcagtgcctcaatcacctagtcctagtcctctgggtagggaaggaacagaggcagggacaggacatccacagggggtggtggccactgtccccacagggtgcccaggcctgttcctccccctcctcctctctgcccatgtgcctcctgcccagtgagggcaggggccactccctggagaaggcagcaagggcttggtttggtctcccccaaggctgtctgttcaccaacttgcacataaatgcttactggggccaggctcaaggacacagggagggtgggatgaaccgaggggagctgtccagtcattggaacaggcccacggcccatgtttggagcaataaagggagaggggatctccctctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaaaaagattaagcagagaagtatataaagtaaaagcaagtgcttctgcttaccatctctcacctcttcccagagatagccactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaaccacattcattgcttataaactttgttttataagcaaagtttagatgagccagaatttatttccactaaaaaatctaaatgacaaatgatgctgcagtggaaatttgtgtgtgtgtgtgtgtgtgtgtgtgtgtgtgtgtgtgtgtgtgtgtatgtgtacaaagtgcacttatatatctccccaggatagatgcctaaaagtggaattgctggatcagagagaatgtacttttgaaatcttataggtagtgtttccaaaagtctgtgtccactcactccggtgaatggtagtgccttcgctcctacattcttaccaataatgcaaaattgttgatctttttatattctgcccatctgatgagcaaaaaattgaatgtgtttatggttttattgtgtattttattactggtgaaattattttttatatttttatttattggttttatttcgtctgtgaattaactggtcatcatgttgcccgcctttccattcagttgctttcatctttttatatatcaataacatattgggatatatttgggattttaaccacttgtttagtgtatgtattgtaaatatttttccctggtctgttttacgggtcttttgtttatggggtctcccaccataaaactgtggtaaatttttatgtgtcgaactggtttaatcttttctttatggtttctgtgacctccaccatgtgtaggaagttgtctttatttcaatattataaactcatttttctgttttattctggtacttttggtgtattggtgttttatttttttttctttacttcccctggagtttatttttgtggatgtaggaataagaccttattttccaaataggaaagccaatcatcacacatttgttgaatataaatgcaacttttctcaattactacattactgatttattacattctttctgtggttctcttggtttattgagctattcctgcgcccaccctgttttgattattttagctttatggtatgttcggtaactggtagggaaagaacccgtcattgttactttttctcaaaatagtcatgtctattatctgtcattcttagagttggactgcagaattggttctctaattttcaaaaatcattcttgtgttatgtggtaatatcacagaatatgggattaatttgagaactgctatctttataatgctcagtgtttttgttcagagacatgatgtactctccattcactcagataagtggtttaatattttattcatgcaaatcttgcacactttgttttttattcataaagggtttgtaaatataattttattgaagttataaattttttcacaattttatatcgtaaatgattactgtttctatagcaaggaaccctattaacttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataaactcttagagtgtgacctgggtgtttttctttttctctgtaggatgttaatagtatcttgtgtcatgctaggatgtctaggacagagggcaatacaatgaggggaaggcattctgcgatgtccccaggcctctggcttgaagagtaacttgctgaagtgaggactctgtggaggagcaagttatacagaaagaagtttagttgtgatctgttgagttggaggtgtctacagggcatccaagcagacataggttgaggaggcagaatatatgtgaatctggagccaagaagagaggtaagggctggaaatagggatctaagacccctggacagttgtgagtgtgcacaatgagggtcagatgcagagaaaattaggagactacagagagcagaacccagggtggggatctgggagtcagcagttgggcatgggcctggtagaaagggaagccaaggaggaggagagggggcagtctcagacaccaaggaggggagagtgactagaaagaaaaccttcttgcagagacataggggatggggaagaactgcagactgaactggggcaaaggactgttggccttaaccagagagatttgagggagagatgaggctgagagccaggggatcctgccatgtcccagcataaaaacagtacctgacacagatgggtgcttgggagctgttgtcggatgaatgagtggacagatgcatggatggacggatggatggaaggatgatagattgatggacaaacagatgaacagatgaatagctggatggacaactggatggatgggtagacagaatgatctcagagatcagaaaaagcttcatgcactaagtgggactgaaccgcgtctccatgggtagaaagcagaggaatctccacttgagtcaggaatgacccagtgctctcaatccagggagaaagccagcctggcttcactggggacacttgtgtgggggactcagaggccctttaaatgaggccagacgaggttggacaggtccaagccaactcagcactcctctgccacactgcacaggaggggatgtgtcactcagggagttgctgggacctatgggtcccagtgttgtcatcagcaccgacagcctcagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacattgcccagtgactcctggggtcaaggacagaggctgctggggtgggcctgggagctgctgagtctcatagtctaggggagcagccccaagaacagctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaa

SEQ ID NO: 2504 - DNA, 8055 bp, Homo sapiens; identical to SEQ ID NO: 2503

SEQ ID NO: 2505 - DNA, 103071 bp, Homo sapiens
attgctagtcacaaagcccaactttttattgaagtataacatacacacagaaaagtgcccagatcaaaagtgtacagctccaagaatgttcacaaacggaaagcacccaggtaaccggcaaccagatcaagaaacagaacaccccagaagcaccacctcatgcccgcttctggttactgtcttcttaggactgatctctacttgcaaccgcatggatgaattttgctgggttttaaactttatataaatggaatcctatggtgcatttttgccttatctcgttcaacactagggttggtgaatacactccaagttgggggtggagttgcagctcattcccattgcagtctgggattccatcgtgtgaatataccctaatgtgcttatccagccaacatgggcattggggtgctttcctgttcggggttattatggagagtgtttttgtgaagatttagagcatgtctctggatgaacacatgtacacatttctgtagggtatacacctaggggtggaattgttaggtcatatatatttacatccaactcaagctctttcatgaaagaagaaagaatgtactggatggagtttgctggctcaaagaattgacagaaaactagaagggaggtctgtaggaagataggtggaggcggagacagctcagcgagtccaaggagtggagcagaaatgacattcccaggacgctgccatccctggacattgctaccagtggacacaccatccctgcagcctgccagccctacccacctgccttgctgtatgactaccaaccccggaccacggtggcttccttgaaatgagtctcagcatcccttcatttgtgtcacattctccaggctcatagccccaagcaagggtccaggtagtccaccccaggtcaatgaccacttcccgactggtatggggctggaagcggggtgtgcctgagagacaggaaatacttcccttcttcagcttccacggtgggtactgcacaccactaagtttatatctaaggcatgatgtccctgctgtaggaagggaggggagatgctggacagttaagctgaaaacacaaaaatgacaactgtccccacagctgcactccacaatgcaagcaggctttattccattcatcttccactgacagagtgggggagctcagtgacatgtctgtggatctcacagctcatgtgcagaaatctccatctaagaagagggaactaggccaggcgcggtggctcatgcctgtaatcccagcactttgggaggccaaggcgggcggatcacttgaggtctgggcttcaagaccagcgtggccaacatggtgaaactccgtctctactaaaaatacaaaaattagccgggtgtggtggcgggcgcctgcaatcccagctcctcgtgaggttgaggcacaagaatcgcttgaacccaggaggcagaggttgcagtgagccaagattgcgctactgcactccagcctggacgacagaaagagactctgtctcaaaaacaaaaacaaaaacaaaaaaagaagaggcagctggattcaggatcactctaggaagggtgacccgtccccaaatgccataggtctggaagaggtgcagtaaaaggacagaaaagcatctcacaggggaaggtaaggaagagaggaggaaaaggaaaaggagagagaacaaaacggaggctgaatctggagggacggggcatgtaaaaacaacagggagaaggtttggtggaagaggaaagcagcatttttctgacctgattttgatgctctctgtacggccccgctttctcggcttctctgatgtgcctttatgacttgtgcttcgcttcatcgggttaatgatgttgacgtgaagcacagaataaagagatcctggtcataactgcactatcaaaggatctgaggtcctagcgtcacatccagcatacaattctgctctagtttgagcatcttaacaacactggtattattagtgagctgataatgaaactaagaatgagttttaacaaaagaagcaaggaacaaagatgtcctaaatccatttacgagggcagcaagtcattaattggtctggaaattacatttgcctctttgcaggcaattttatgcctccaacggaaccatggtctctttgaagtcatccattcttccctatattataccacggcatttagtacatttatttgttttaaatgataatcagagctttcatctatgtagcatctctgtttcctcccagacagaaaggcaggataattaccattaaacccaatttgcaggttagaacatttcaggcacaaatggcctgttctctatcacacagcaagtctctttcagaactagggagagaggcagtttccaaataaacagaatagaacaaacttacacaaagagctctgctcccactgtgtattctcctctttcatcgggatcatatgagtttggtttaggtaggaccttcaggttgatcttagacaatccaagagctaattcatcgatgtctagcctttccttggggcatccatgaatcaccttccttaaactaccagaatacggcttcctcctggagaatgtgggaagtgaagtgtgccacgggttactgcaacaaaggtgtttgcttcacggtgtgcagttatgatagtttgtgggtctccctacctgcaaacaggtagacctggaaggtagcacagttcagggggctaagggaactctggggccgggctgcctgccctcaaatcccagtttttctgcttaccatgtgtaaccttgggcaaactacataaacgctttgtgcctcagtttcccctcactctaagacatacggccgggtgcactggctcacacctgcaatcccagcactttgggaggccaaggtgggcagatcactcgaggccagtagttggagaccagcctggccgacatggtgaaaccccgtctctactaaaaatacaaaaatgagccaggcatgttggcgtgtgcttgtcatcccagctactagggaggctgagacatgaggatcacttgaacctgcgagtggaggttgcggtgagctgagattgtgccattgcattccagcccgggcgacagagcaagactctgtctcaaaaagataaataaataaaataaaacagacatgcacttatggtatttattgttggaagattgagtaccttaatgcacaccaatgctcagatgacttgggggcacataggggactgctgtcaccatgcctcactcctgcagggaaggggctgccctactaaaaccccagcgggcccagtgctgtgtccagaacaggtccttatattactgcagcccacaatggaactactgagtaggagccaaaagaggagggagcaggaagaggtggcatttggagaggggagaccgcacccacaggtctgccacagcgcgtcaacggtatggggtacttttacagtcaagttgacttcggtgtccgcccaccatctacctttgtaggaccactgaaacaagggacatccaccacggcccacagccggggcgccacggccccaggaggatatgctaagaaaaccattccacggccgggtgtggtggctcacgcctgtaatcccagcgctttgggaggccgaggcgggtggatcacgaggtcaggagtttgagaccagcctgaccaacatggtgaaaccccgtctttactaaaaatacaaaaaattagctgggtgtggtggcgcgtgcctatgatcccagctactcaggaggctgaggcaggagaatcgcttgaacccaggaggtggaggtcgcagtgagctgaggtcacgccattgcactccagcctgggtgacagagcgagactccatctcaaaacaacaacaacaacaaaaaaaaaacaaaagaaaaccattccaatcctgtgggttgttgtctttttactaggatgatggaaatgcaggaaatacagaacctctgcagctgctttctccaggaaaggagatgaaaacgttatatgtttcagttggtcaaaatgctctaatttgatactgaatattgcaaataagggatatttaggcatagttttttttttaaaataaattatccactgaaatgtattaatatgatataaacttggaaactgatgtttaaaaattttaaactcttaagtccagacttacttttacatggcacatttgttatttggctataaacattttgattttctttgccaataatgaaaataacatgaaaatgaaaaggaaaaaaatgaaattgaatgccacgaagaaaacagatggaaacataagacaagccccggccactgttggctgggcagggatgggtgttggtctcactccctaaggcttagagcatgcatggtctctacaggggactttgaaggtcagaaaaggaggcgttttcatcacacacggagttagagaatggtacaaaagaacttcttctcgcgaaaggggttttctgatgcaggcactggaatgatgagaggatcttcccgcacgtgagcttcacagtaggccaggaggtccgcagctgcctgggagacctgtgagggcacagagcacaggtgctcagttaaaggcccctttgcagagtgagtccagggaagaggtgtccacgtacagaggggacaagccctagggtaggctgtattgtgtgcacggcctacaacatggtcatgcccaggctggagggagggtttgtgcagatctaggagactggttcgaagcgggcctccaagaaggggaggctgccctcgcatggcaggccagcatggagacaggactgagggctggcaggaggcccagacagccttgatatattctcgagtaggtgaggagtggaggttccaggacagtagtctcacaatgactttgctaaaccgtttctggaagactaaagcagaaggcagcccctggccaagccagtgtgatcatatttattatcattattagttgttttattgcaatccactcttgtgaccaacacagagagacacttcatcctcctcaacagaacttgtatttagctatattttataagcacacgttttatttttattcatttttcatttttatttctttttttgaggcagagtctcgctctgttgcccaggctagagtgtggtggcgtgatctccgctcactgcaacctccatctcctgggttcaagtgatgctcctgcctcagtctcccaagtagctgagattacaggcactcaccatgcccagctaatttttgtatttttagtagagatggggtttcactatgttggccaggctggtctcaaactcctgacctcaggtgatctgcccacctcggcttcccaaagtgctgggattacaggcatgagccaccgtgcccagccagcacacatgttttaacttggagtggccacttccctgcggagagaggtgctcctgaccagaaagttctttccattccatttctttccaggcttatctgaagcctgctggcgcatggcagttgtgcatcaaactgtccccaagctcaaggccagaggaagagcaggttgggagagggcggggtgcggacaagcatttgctaagagggagaggcagttaccagcttattttgttcatggtctgtgtcatgtgcttggcagataaatggcctgtgcattaactcatcctgccaattaggctgttctgcctgcgagtatttattagcggattacaggcaggggtaaatacatagcagtcaaatgaaatccttttagtacattcaatgtctaaatcttccccagaatgataaaaatgttccacagatgaagaaaaaaaatgtttagaagcctccagctacacaggccatacacattcccttctgggttttaaaaattggctcatctttcagcattttacagagattcttctgattttcagacctaaccgctttagcaatggctagaaataattccagcagagatatacaatgaatcaactaaacacatcactcaaataaatcaacttgaagtttagcagatgagttagtctaaatcctgacaaaacctacatttgttaagaatgtggcatggagaaatgagttccggtgaacatcaggcttctagatctacccccgcccgtaagctagctgtgtgaccttgggtaagcagctcaacctttctgagcttcacttccctcatttgtaaaattcaggagcgttggagagctctaaggtcccaatttactctaagacgtctatgattctacctttaatagcatggtcagtatttaagatcctaaaaacgtgtatgttgagttgaataggagtgtttgaagtttgcagtgggttacaggacgcccatataggaatttcccagatgggtgaggctcaggggaaaactgagcctgtggggggcctgtgaagccatcacaaggagcaggagcacaggcttaaggaaatggactctgaggcccacagggctgcgatggacacacaagagaatggaatcacatggtgagtgctgcaactcaaagccggtggacttgggagattgagccctcccttgctgccaccttctaaggaaagccaagtgccctccccaactgctggagtgatgacctccttagtttccactcctggcttctcaccatgcccagagatgcagaagctgctgaggtctggggtctccctcatggccaccatgttaggacagccactaaattcatccattgacccctctggcaacccctgggcagtggtcttcactgctgcctgggcagcacacacaagggctgcagtgttggaacaaccacattcctcctctaggagccactgtcctcttgggtttgctaagtctaggcccctgactccagtgagctcttctgggagttccgtttaagaatggctcggctggacgcagtggctcacacctgtaatcccagcactttgggaggccaaggcgggtggatcgcctgaggtcaggagttcaagaccagcctggccaacatggtgaaaccccgtctctacaaaaaatacaaaaaattagccaggcgtggtggcgggtgcctgtaatcccagctactcaggaggctgaggcaggagaatcgcttgaactcgggagttggaagttgcaatgagctgagattgtgccactgcactccagtctgggcaacaagagtgaaactccatctcaaaaaaaaaaaaaaaaaaaaagaacgtctcgtctgactatcatgccctctccagttttctagttttcacttttcccatctacttcattttttttggacatgctccagtttcatctgaattctctataatcctcgttatgtcattcagaaaggaagtattcactatctaccctttagctaattcagaggatgcaagagaaagaataaggcaacagttttgccctctagaagatctcactgtgatctcaaacatgatgaagtcactataataatccatgtgtgctgaaatgtcacaaaagaacacttgcacgccactgtggatccatgatgagaggccaggagacggggcatctgacaacctgtccagtcccagacagtagaggacaccttggtgaatctgccccctttcttcagagggcaatcactggacttctgggcccagaaacacaatttcctggcacactcagaatagatcatctcttgtggctgacccatattaaacaagctcaggaggcagctggataaaaccataatacaaatagaagctaacatttacatttactgagtgcttctcaggtgccagcactatgctacatgcatcagatgtattatgtcatttaattcttcttatacgtacgactctagcctgggcaacataacaagactctaccataaaatgaaaaaattagccaggcatgatagtgcacaccggcagtcccagctacttgggaggctgaggcagggacatcgcttgagtccgggagttcaaggctgcagtgagctgtgatcgcaccactgcacaccagcctgggtggcagagcaagaccctgtctctaaaaaaaaaaaaaaaaagtagaattccttatttataattgacaaataaaaatggaatatatttatggtgtacaacatgatgttttgatacgtgtatacattatagaatggctaaatcaagctaactgacatatctattacctcacatactttttttgtggttaaaaacataaaatttactcttttagcaattttcttttttcttttgagatggagtctcactctgccatccagactggagtgcagtagggcgatctcagctcactgtaacctctgcctcctggtttcaaacagttttcctgcctcagccttctagtagctggggttacaggctcctgccaccatgcctggctaatttttaaatttttggtagagatggggtttctccatgttggccgggctggtctcgaactcctgacctcaggtgatctgcccgcctcggcctctcaaagtgctgggattacaggcatgagcctctgagtctggcaagcaattttcaagtacacatgataagtattatcttaaagccactttacagatgaggaaactgaggcacaaaggttaagaaggtcacccatctattaagagaggaaaccagggccgggcacggtggctcacggactgtaatcccagcactttggggggccgaggcaggcagatcacaaaatcaggagctcaagaacatcctggccaacatggtgaaaccccgtctctactaaaaatacaaaatttagctgggcgtggtggcccatgcctgtaatcccagctactcgggaggctgaggcaggagaattgcttgaaccagggagtcagaggttgcagtgagctgaggtcgcgccactgcactccagcctggcgacagagtgagactctgtctcaaaaaaaaaaaaaaaaaaaaaagagacagccagaatttgaagctaagctgtactgtactacagccgtccccaacgttttcggcacgagggagtggtttcgtggaagacagtttttccatgaactgggggtggggggatggtttcaggaggattcaagtgcattagatttatcgtacactttatttctgttattattacattgtaatacataatgaaataattatatacaattcaccataatgcagaatcaatgggaggcctgagcttgtttttctgcaactagatggtcccatttggaggtgatgggagacagtgacagataatcagacacaggattctcataaggagcttgcaacctagatccctcacacgcgcagttcacaattgggtttgtgctcctgtaagaatctaatgccgctgctgatctcacaggaggcagagctcaagcggtaatgcaaccaatggggagcacctgtaaatacagatgaagctttgcttgctcacccgctgctcacttcctgctgtgcggcccggttcctaacaggccacagactggtactggtccatggcccggcggttggggacccgttttatactacacagaatctacactcgatacagaatctataatctacactgtatacagaatctatactcagccgctatactacagcagctgctttgttaattgacaatgagacccgtaattctcaagtggcctggaacattctcacctgcccatccatccagtgcacacgaggagagatccttgtggttcaactacctgggagctcacaggaccagaagaaggagagtctcccacctagagtgtcttaggtcatttcgtttaacctagagacaggaggtgtcctcagctgggactcaccccctttccccccggccctgagaagtacaggatggacacagccactgtggtctccaagacaccccttcctctaggctgtgacccgccaatccccttctgtctacacatacaatccagctggtcagaagttggctggctaaactgtcacgatagctctcttcccattgatcagtttacctgtcccggtggttatcaacatccatcatgggccagttcgactcttttaattctctaggagcaacctcaagggggcgcctcactggggaagctgcactatcaaccagtacatcctgtacatcatgaccaagcattaaaggagtgggctcaaaaaatgtcggggcttcgggggacagctcagtcgaggagaagtcaggttgggcccatgttccactccatagcagagtaacttcttcccttacagcccagtgtctgcaacaccctaacaattatgctattaatggtctggccttgccaggtctaagcaggtctcacctaggaatttttctctcacctcccaaaggtgatactgtacctgatgccacaatttttcttgcaagaaaacgagttgttcttagattgcctccttttgttgctttaagatcacagttgcgtttgctgagttataaccactcctctggcttgctgagtcctgtctgtgcacccatacaacaggaatgcacacacaatgaagccagtattactgccgatcaagaagtgctcagtttaagcccgaatgtgtggatctgggttggttccgtgaaacattaatttcctaggtgcactcagaattactgaaatgtaacactgtgaagaatggcccacttacgcacagctgcatctaatacagcataagtcatcttacagcaaaatagtcaagggagttttccaccttcatcaccccgtcttttcacatagcgtccagagtcctatataacctttataaccaaagtatcttgggtaacccctgaagtttattgttaatgtgatctgaaaagataaatataggtaatgaccgtctaaatgagcctgacacatgaaaggtggcgtcccaacaaatagctcagtatccaggtattaattaacctgagtctgctccttccgctgagagggagagttttcttaatcagccctagattgatgtttatggttggaggtttccttcaacacgtaccaaataggggttgcagacaacgccagatcccattaaacatctgccatctttggaacataaagtagacaatttgctttcaaagagaaaatcttattctggtagaaaattgcaaattcctttactgtgtatcctttctcatcaagcctgaattcggctttccctcaagttcactgtgatgaaatgcctggagcatctctgtgcctccccgtcttagtattgaactgttagagttacaagacaacagatgttgaaaagaattggtagcttgggaacaactgtggaattttaccatcacatttcagagtaaaagaggtgattaaggcagcccaagttagcacgtaatcctgttagttgcactataattacaagcttcaatgatgggagaaaatgccgcaattactatagtcacattccatgacaagacagatgacataattattattgtggctgtgacacccactgcatttatcctttgcatctgaagtagacagacccacacctatttctaagcaacgctggtctatttaacagtactactgggaatcaaaagcatcttggttggctttgcctgtttctcctactccaagaaaacaaagcaggattacagttaatggtacagccaggttgcagccagcatggtgtaacggtatattttacaaggtctataatggtatatttttacacggtgaaatttggtgcacactccactagaagatatcatatactgcttatcctcagtgggatcctggggacattacaggtatatacctcacctttaaattctcagaaagcactgcagggtgaactcttgtgcttttttttttctcctaacattgggaagtatttgagacccacacaccagttcctaagggcagtctctagatactttcatattatggctttcagaggatcccagtaactacttcgtactattcctggtcagtgtgggcaattcttacttgttggcggatggcctgtgtggggagaggcttccgccctgtgggtgggtcctaggccacaggcaacatcaagcttagagtgggttaggttatacctgaaggtggaaaccagagagaggagggtgggtgatatgtgtgaataaaagaataattcaacagagtccgtctctgaacccttaagtcaaatgtccatagcagcagactagccactgttaactactttcagcataggctttttttccacatcaaaagttgattgcacattgggagctaaatctaagatgcttgaaagagagttgtaatatcaccaaattaacttaagtaagagttgttctgacatggccttcagcacaggaatatcaaagccctcacttgtttagaatatgattgacctagatccaccctggaccttgacttaaccaagcccgttcaacaggtcagtgtttgtcccatctgactgactatctctcagttttgatatttcccaaatttccaaaaagaaatccataattccatcactttgcaagtttgccatgctggataagatggacactccaggcactcagctttgactcctgtaaacgagaacggcaacacctgctggtttgtggctaaatggatgccatcatatattgccgtggtttgaaagtgctgtctcccaaaagcatgttctggaaacaatgcgagcatgttaggaggtgaggcctaatgagaagttattaggtgatgagggctctgttctcatgaatggattaatgctgttatcatgggaatgggctccttataaaaggatgggtttggccccttttttctctctctgcctctctccttgcccttccgccatctgctgtggggtgacactgcaagtagcccctcaccagaggtagccctttcccagcccccagaactatgagttaataaatttctgtgcatcataaattacccagtctgtggtattctgttacagcagcacaagccaactgaaacataagcacatggggttattaatccattattcatttggctactttctagtaggacagagaagatacttgagaaacagacacgaagaagtttctcagaaattattagggcattggatgcccacaatggccctgaccagatcatccccatgaatagaagagatccctttctaagtgcaactttcattttcttcttctactactcatgttctactctttcatttaatccgaagcattttccccttttatctgatcccagttctagaactgctcatcctaataacctttcctcaatatggccagatttttggattttagccattctaataggtgtgtagtggtatcttattgttttaatttgtaattctctagtgacatgatgttgaacatgttttcatacgcttattttccatttgtatgtcatcttttgtgatgtgtctgatcagaaattttgcccttttcttttttcttttgagacggagtctcactctgtcgccaggctgcagtgcagtggcgccatctcggctcactgcaagctccacctcacgggttcaagacattctcctgcctcagcctcccgagtagctgggactacaggcgcctgccaccacggccggctaattttttgtatttttagtagagacggggtttcaccgtgttagccagcatggtctcgatctcctgacctcgtgatccgcccacctcggcctcccaaagtgttgggattacaggtgtgagccaccgcgcccggccattttgcccattttttaatgtggttggttgttttctcattgttgtgttttaagggttctctctctcttgctctcttgcacgcgctcgcgctctctctctctatatatatacattttttttttctagacgagtcttgctctgccacccggctggactgcagtggtgcaacctccacctctggggttcaagtgatctcccacctcagcttcctgagtggctgggattgcaggcacctgccaccatgcctagctaatttttgtatttttagtagagatggggtttcaccatattggccaggctggtttcaaactcctgacctcaggtgatctgcctgcctcagcctcccaacgtgctgggattacaggcgagagccaccgcacttggccctttatatattttggatacaagtcttttatcaggcatgtgtttgacaaatattttctcccagcgtgtggcttgtgttcattcccttaacagtgcttttcactgaagtcttaaattttactgtaatctagcttgtctacttttttctttgatggattgtgcttttgctgttgtatctaaaaactctttgccaaacccaaggtcacttagatttcctatgtcatcttctagaagttctgtagtgtactcttttatatttatgtctataatttattttgagttaatttttataaaatgtaaaaggtctgtgtctagattcattttctgcatgtggatgttcagttgttcttacagtatttgttgaaaagactatctttgcttcatggtattggctttgcacctttgtcaaagatcagctggctatatttacatgggtctattttggggctctctattctgttccactgacctacacgtctactctttcaccaataccacattgtcttaattactgtagttttatagtaagtctttcagtcaggtagtgtcggttctccaactttgttcttctccttcagtattttattggctattctgggtcttttggctttccatataaactttaaaatcattttgtcaatatccacaagataagatttgctgggattttggggtggggcacagcagctcatgcctgtaatcccagcactttgggaggtcgaggcaggtggatcacttgaggtcaggagttcaagaccagcctggccaatatggcgaaaccccatctctactaaaaatacaaaaattagctgctgggcatggtgggcctgtaatcccaactactcaggaggctgaggcaggagagttgcttgaatctgggaggcagaggttgcagagagccaagatggcaccactgcactccagcttgggcaacagagcaaggctctgtctcaagaaaaaaaaaaagaaaaaaaaaaaaagaaaaaaaaaaaagaagaaaatttgctgggattctgattgggatcacattgaatctacagatcaagttgggaaaaactgctattttaactatattgagtcttcttatccatgaacatggactatctctccatttatttagatgtttgattttttcctcagagttttgtagttttcctcatatagatcttgtgcatattgaatatatctgatatatttttgcccatctttttacattcaacctgagtcactttattttaggtctatgtctaatgcaaaatatattctttttaaaggttaaatctgataatctaaattagttttcccacttaacacttattattaagatagatgtatttggtattgtttctgctgtcttattttgtcttttgaaacttttacattctcttttgttttctgttgatgttccatggtctttatttcttgtactccagtaattaagaagtataggccaggcgtgatggctcatgcctgtaatcccagcactttgggaggctgaggtgggcgggtcacttaaggtcaggagtttgagaccagcctggccaacatagtgaaaccccatctctactaaaattacaaaaattagccgggcgtagcggtgcgcacctgtagtcccagctacttgggattgcttgaacccagaggcagaggttgcagtgagcagagatcgccccacggcattccagcctggacaacagagtgaaactgtctcaaaaaaaaaaaaaaaaaaaaaaaaaaaaagcgttttatctttatagccttaatatgtttataatgttaatcaatttcagaaatgaagttatattgattgattcacatctatgaaatatgaggaaattggctatactggacaattatcatgcatgttttcccccagcaactgaaccccttctctggttggaggaatgatctactttatgagtcctcgtgtggggaaacaattatttctcttaatagatctgaaaatgttaaatactcaccttcccagaatcttgcaacttggcacatgtgactttgtttctgtctatctgacacacatgtgccagactttggtgaatgatctgagggaaaagacattaggagcttttgttctggtggcagtggtcctgactagaaggttgagttcctggctcagagtgatagtggtataaactgtagcatgtagtgctgggtggtgattgcagcagttccttcctcagactgttctgcagtgtggttttgagtgctgttcccagaagatgaatcttaagcccacttctctagactttccagcaattttataagctattcaaaatccctttaataaattccttttataatcaacctagatgcttaccaacagtggactggataagaaaatgtagtatatatacaccatgaaatacaatgcagctataaaaatgaatgaaattgtgtcctttgcagcagtatgaatacagctggcggccattatcctaattgaattaatgcaggaacagaaaaccaaatgccacacgttctcatttataactgggagctaaatattgagtacacatggtcacaaagatgggaataggagacaccaggaacgagagacacactacttgaggggtgatggggggaggaaggtaagggctgaaaaactacctgttgggtactatgctgactacctgggggatgaaatcactggtgcaccaaaccctactgacatccaatttacccacttaacaaacttgcacatgtaccccttgaaactaaaattaaagttgaaactaaccaactaactaaattccttttatgtttactcagccagggtaagcttctgttatttgtaataaagactcttggactgacaggttgccatatttatactctcctctcttctccctcccctattttaatgtaagtattttctaggattgtcatagtctactactgacaaatatttatttttacatcatatagatttctgagaagaatgataaaaattacatttttttaagagtggtcatcatagttattattattttttttagacagagtctagctctgttgcccaggctggagtgcagtggcacaatctcagctcactgcaacctctgcctcccgggttcaagcgattcttctgcctcagccccccgagtagctgggaccacaggcgtgtgcctccacgcccggcttattttggtattcttagtagagatggggtttcaccatgttggccaggatggtcttgatctcttgacctgtgatccgcccaccttggcctcccaaaatgctgggattacaggcgtgagccacagcgcccagccagttattcttaattctaagtttacattgattgaataaccctgcaacttctttcctaccatgccatccccgtgtggaagttatttcgattcagtcagctggctggatcccatgttacacacatgtatgtgcagagtccagaggaggcaggagaccactcgggccatggtgctggcaagaatcctgaacaggaaggtcgtctctgagcaagtcagaggctaaagaaagagggtggcagttggcccagcgcagtggcatgcctgtaatcccagcaatttgggaggccgaggtgggcggatcacctgaggtcaggagttcgaaaccagcctggccaacatggtgaaaccccatctctactaaaaatacaaaaattagccgggcatggtggtgatgggcgcctgtaatcccaactactcaggaggctgatgcaggagaatcacttgaacccaggaggaggaggctgcagtgagccgagatcgtgccactgcactctagcctgggcttgtgacagagtgagactctgtttcaaaaaacaaacaaacaagcaacaacaacaaaaaacacaatatggcagtgactagaagatccccaaaggtcctgggaataaagaacaaccacaatgggctggtgcaagctcttcgtcaggctcccaaggtgagagaattgcttgagctcaggagttgagagcagtctggcaaacatagcgagacccccgtctctattaaattttttttcaattagctggacatggtggtatgtgcctacttaggtttgcttaggtttgacagcttctcagggtggaacttttgaaatacgaggcagtagactgcccagtcgttcctatggagttcatcatcagcctcacaggtgacctagtgttctttttggggcagctgctgatgtttgtgcattccatgagctgacacagagggacagaggtcccttttaccatttggtatcttcagtcaatggagtaagaaagttgtctgatacccaaatctgaaggctattaagagtgagaattgagaatctgactctatcacactgataaagaattgagcagaattctaggactgaatattgacccagaaactataacttggcagagagcatttgaatcccagtgatagactttggaggcagatcacctttggagagtggtgactcacactgatgtctccatggtgagtgaaatcgtgagtgttctgtctttcaacagtgctctaaacaggggtctccaaccccctgccagggaccagtaccagtccatggcctgttaggaagcaggctgcacagcaggaggtgagcggccagcgagtgagcattaccgcctgagctccgcctcctgtcagatcagcggaggccttagattcccataggagcgtgaaccctattgtcaactgcgcatgcaaggaatctagcttgcatgctccttatgagaacctaatgcctgatgatctgtcactgtctcccaacacctgtcctgtctagttgcaggaaaacaagcttagggcttccactgattctacattatggtgagtatgtaataataatagcaataaagtgcataataaatgtaatgcttgaatcatccccaaaccgtcccccatgacctgtggaaaaactgtctcccatgaaaccagttcctagtgccaaaaagggtggggaccgctgctctaaaagataggagagactgaggaaaatggcggtgctatctaatgagaacggggatgctaccagtgctgaagatctgggtgtgagtggtgccttgacaagtgctatgaaggatgcatcaagcccagtctcatacagactcagagggaatgctaatattcatctgatggacatgaagccctctagcacagcaggtccaacagcacgaagacttgttggttctgaatgctctatagcgatggaagctggatttggagataactttgtcttgaaagcagtttttttaaagtattattattattattgaaataaagtcttgctctgttgccctggctggagtgcagtggtgagatcataactcaaagcagcctctgtcttctgggctcaagtgatcctcccacctcagcctcctaagtaggcacataccaccatgtccagctaattaaaaaaaaaaaatttagtagagatgtggtctcgctatgtttcccagactggtctcaaactcctgagctcaagcaattctcccaccttggcctcccaaagtgccaggattacagacttgagccactgcacccggcataaaaaaatgtttaattataggactatatgtttatacaaatatatgtgtacatatatacacatatatgtgtatttctataaaacatacatgacatcaaatgcatcgtcttaactatttttaagtatatagttcagtagtattaagtattttcacattcttgtgcaactatcagtaccatccgtctccagaacttgcaaaactgaaactctgtttccattaaacaaccctccattctctccttcccccaggccctggagaacaccattctcctgtctgtttctatgaatttgactcctctaggtacctcatataggtggaacacaatattttgtctttttgtgcctggcttatttctcttagcatagtgtcctcaaggttcattcatgttgtcccacatgtctgagtttccttcctgtttaaggctgaataattttctgttttaagtatacactacattttgtttatccatttatctgttgatagacatttaggtagcttctatgccttggctattgtgaataaactgctattaatatggatgtacagatctctcttcaagaccctacttccaattcttttgagtctattcataggtgatacatggattgtctcacccgatcccatttctataatattgatttgggctctgtggaatcctgataaataagcaacaatgaggaaggggtcccaggttggggagaacaattgttctgagagacggctaaccacaaacaggcccttgcacaacatcctgttccctcactctgcacgtagccccagcagcaggactgtaactgcacgaaccccctccagcatgaccctataaagcttccttccagcccctgcctttttggagacagtcccttttctgctgtgctgcccgttgcttccttgcaacatactttccttctaataaatctgcttttttttttttaaacctatgactgccttggcaaattcctttagcactcatgatccccgctctagtcatcacacctgcaacaggccctgcatcaaaacaggtgactgagctgttccaagtacatcaagcccatccttcagtgccttcaatgcctcctatgactcagattgtgtgtggatccagccatgtgcaagaccctcagcccctgctcgggaagaccttttgactgagcaggcattttctcagctttcttatggtcttaatgtatattatcatgtgtaaattaacataattatgcacatctgtatctcctttagtgaaattcaatggaataaaataaaataagtttgctaaagaaaagcagcacatatttgcattacatttaaacttctgcataattgagaatatatctatgttgccatggacataaatggccacttggttgggtagagaattcattgtagatgctgtttctccttgggctgacatcttcagaactgtggggaagtgttgtccagactgatattttcctcctttgtgggtgaggcactgtagtgtaatgatagtacccaaggttctgggtttgtatccttccttcatcaaatgacaactctggacctcttttctttttctttcctttttttttttctttttttcttctcttttcttcttttcttttctcttttttgagatggagtcttgctctgttgtccaggctggagtgcagtggtgtgatcccggctcactgaaaccttctccgcctaggttcaagcaattctcctgcctcagccacccaagtagctgggactacaggtgctcaccaccaagcccggctaatttttgtatttttagtagagatggagtttcaccatgctggccaggctggtcttaaacttctgacctcttctgatcctcctgccttggcttcccaaagtgctgggacaacaggtgtgagccactgcacctggcctgggcctgttttcttgtctgtgaaatggggtactgatagcaccaacatctcagggctggtgtgaaaattcaagcacctaacacatattaagaatgtaccaaggctgggtgtgggggctcacgcctgtaatcctagcactctgggaggccaaggcgagtggattgtttgagctcaggagttagagaccgcctgggcaacatggcaaaacctagtcttagctatttgggaggctgaagtgggaggatagctcgagccgggaaggcggaagctgcagtgagccaagatcacgacactgcactccagcctgggtgacagagggagaccgtgtctcaaaaaaaaaaaaagaatgtaatcaaagttaggggtatttgtcctaactgactgcttcttctgcctatattcttttttttttgttgttttaagatggaattttgctcttgttgcccaggctggagtgcaatggcacgatcttggctcactagattcctcatgacctctttccttgtttactgaagcagtgtttgaacgcctcccaggttcaagcgattctcccacctcagcctcccgagtagctgggattacaggcgcccaccactacgcccagctcatttttgtattttcagtagacagggttttaccacattggccaggctggtctcgaactcctgacctcaggtgatccgtccgcctcggcctcccaaagtgctgggataacaggtgcgagccactgcgcctggcctcttctgcctatattcttaatgggctctttattattagtattgcttttgttttgctttttgctattgacttatttgttgatggagagatcactctttccttttgagattaagaccctcagctgtatttgtgtctgtgtcgatcatttctctcacactcttttctggaatacggcaagcagtttggacctgcagattcaggtcttcctttatttaatgaagctgttttatgttatatcctgaagagtattttctattccatttattctctctgccaggaatattcgcatacaaatgtgagaatgctcttgtcagtctggatttctatcagcttctaattgcttcggtctgacactccatctgtttcttttgtttcctgtgcaccttcctgaggcctgtctccaggtcatcactgtggctttccacagcatgtgtgccactctccactctttccagtggtgctcccacctccctccaattctttccttagcttttccacctccctttccaactcgttagtttcacctcttcttttttttttttttttttttgagacggagtttcactccgtcactcaggctagagtgcaatggcatgaccttggctcactgcaacctccgcctcccgggttcaagcgattctcctgcctcagcctcccgagtagctgggattacaggtgcccgccatcatgcccagctaatttttgtatctttagtagagacagggtttcactatgttggtcaggctggtctcgaactcctgacctcaggtgatccactccccctctcagcctcccaaagtgctgggattacaggcatgagcaccgcacccagtctaaataaatttttaaaagacagggtctcactctgtcatccaggctcgagtgcagcgccgcaatctcggctctctgcaacctcaacctcccaggtttaggtgatcctcccacatcagcctctagctaggtacatgctaccatatccagctaattatatatatatatgtgtgtgtgtgtgtgtgtatatgtatgtatatatgtgtgtgtgtgtatacatatatatatacacacacacacacacacacacatatatatatacatacctttttttttttttttttttgaagagatagggttttgccatgttgcctaggctggtttcaagctcctgtgctcaggcaaacctcctgccttggcctcccaaagtgctggaattacaggtgtgagtcactgtgctggccttaaaatattctacaatactacaatagaaaattgggtaaacggtaggaatagccaattagcaaaagaagaatttaacatacaaaattagtttaaccccagtaacagtcaatgaaatgtatgttaaaataacgaggcgtcagcaatcaagagatggtatgacataaaggttgagagcgaaggctctggagacacactccctggtttcctatccctgggctctcatcacttttcagctgctgaattttaggcaagttaatgaatcttcatagacctcagtttcctccttcatataacagagtacccacttcattggactgctgtgagaattgaatgaatttaatgtgacttgttcagaacaacgcgtattaagcactcagtaaatgttggccgctattattatcatctgttacatttgcatggcataatgaatggtgtttggggggagaatgtgggaaaacacacacattactgataaaaatataaattggtatccctttctatagggaaatttgatattgactcaaacactttcttgtgtatacagtcatgtgtcgcttaatgacggggatatgttctgagaaatgccttgttagatgatttcatcactgtaagaacatcacagagtgtacttctacaaacctagatggtctatcctattacacaatagggtatagcctatagattacagggtatagcctattgctcctaggctacaaactttttaaatgttaattaattaactaattaattattttgagacagggtctcactctctcatccaggctggagtgcagtggcaggatcagggctcactgcagcctcaactcctgggctcaagcaatcctcctgcctcagcctcccaagtagctgggactacaggtgtgcaccacatccagcttacttttttgaatttttagtagagacaggatctcactatgttgcccagcctggtttcaaactcctgagctcaagtgatcctcctgccttggcctcccaaagtgctaggattacagaaatgtgactgtactgaatactgtaggcaactgtcacacaatggtaagtatctgtgtatctaaacagctaaacagaaaaggtaaggtaaaaatacagtactagatatcttttttttgagatggagtctcgctctgatgtgcagtggcaccatctcggctcactgtaacctctgcctcccgggttcaagcgattctcttgcctcagcctcccaagtagctggaattacaggcgctcgctaccacgcctggctaattttcatattcttagtagagacggggtttcaccatcttggccaggctggtctcaaactcctgacctcaggtgatccacccaccttggcctcacaaagtgctgggattacaggcatgagccaccgtgctcttttttttttttctttttttttttgagacagagtctagctctgtcgcccaggctggagtgaggtggtatgttctcagctcactgcaacctctgcctcctgggttcaagcaattctcatgcctcagccccctgagaagctgggactacaggtgcgccaccatgcccagctaatttttgtacgtttagtagagacagggtttcgccatgtttcccaggctggtcttgaactcctgacctcaagtgatctacccacctcggcctcccaaagtgctgggattacaggcgtgagccaccatgccgggtcaaaaaatatacactactagaatcttatgggaccaccgtcatatatgcagtctgtcgctgactaaaacagtttttatgtagtgcctgacagtatatatctctcttttggccaagagattttcagtccttaggaatttatcttaaagaaataatcagacatgaaaattttatctaccagtatgcttgctgcagtgcttccttaaaagtaggactcacaacacatgcacatgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctgagcaaactatcgcaaggacagaaaaccaaacgccgcatgttctcactcataggtgggaattgaacaatatcgcttgggcacaggatagggaacatcacacaccggggcctgtcaaggggtggggggaggggggagggatagcattaggagaaatgcctaatgtaaatgacgagttaatgggtgcagcacaccaaatatggcacacgtatacatatgtaacaaacctgcatgttgtgtacatgtaccctagaacttaaagtatgataaaaaaaaaaataggactcacggcccggtgcggtagctcacacctgtaatcccaacactttgggaggccgaggtgggcggatcacgaagtcaggagatcgagaccatcctgggtaacacagtgaaaccccgtctctactaaaaatacaaaaaattagccgggtgtggtggcgggcgcctgtagtcccagctactcaggaggccgaggcaggagaatcacttgaacccgagaggcggaggttgcagtgagccgagatcgtgccactgcactccagcctgggtgacagagtgagattccatctcaaaaaaaaggaaaaataaaaaaagactcacaattggaaataactgaaatgtctaaggataggagactggttaattattgtacatcgggggaaaatagatattaaaaatgacattttaggagaatatttcctgaccttgttatatgatcacaatatactgttcagtgatatatcaggttataaaaaagcaataagtgtacattatggccccagttttataataaatgtaaaacaaatatagatggaaaaacatcaaaaggtagtggttatagaccattccaattatcctctttatacttgtcagcatttttcaaaaattttaaaaataaacaagtacctaatctcagcactttgagaggccaagatgggaggataacttgaggtcaggagttcaagcctagcctggacaacatggtgaaaccccgtctctactagaaatacaaaaattgtccaggcatggtggcacaggcttgtaattccagctactcgggaggctgaggcaggagaatcgcttgaacccaggaggcagagattgcagtgagccaaggtcacgccactgcactccagcctgggcaacagagagagactccatctcaaaaaacagcaacaacaaaaaagcaagtaccattttaatgaacagagaagtagtatcattttcaaaacaagcattaaaggcccctgaaaaggatatgactttttcacattctcacttcaacccaccagatgttctgcttctttgttggaagcgctttaagtaagctccatgcttaggtatgtgttcgagccactctcatttatttatggttttaaataaattatcaacggaataaagagagtatatacgagaaatatctcaaagacttgtaaattcaacttttgtgtccttgcatttcctatttttttgattatttgttctcctttcttttaagcaccaaattatacccttttaaaaaatagctctttctctttttctgttttctctacatttttcttagtttttatgaaggaagattgttaataactgccagtatctgtcacgacacaatcctttctttcttttcttttttgagatggagtctcccgctgttgcccaggttggaatgcagtggcgcaatctcagctcactgcaacctccacctcctgggttccagtgattctcctgcctcagcctcccgagtagctgggattacaggcacacaccaccacacccagctaatttttgtatttttagtagagatgggatttcaccacgttggccaggctagtctcgaactcctgacctcgaatgatccacccacctcggactcccaaagtggtggagttacaggcatgagccactgcgcctcgccacaatctcttttctttgatgtcagtatctttctgcactatcgcactctaaatacagagggtccctgacgtacgatggtctggctgaatgattttttcgaatttacagtggcagaaagcaatacgcattcagtatgctcctccacttcccatggggtcacatccgcataaacccatcgtaagttgaaaatgtcgtaagttgaactttcaatttataataggtttattgagaggtagccccattgtaagtcaagggccatgtgtagccagttctcctgcgtttcttgggcttcaacttttagtgcatccatcacctgaaattcctctcttcctgcactcatgttttcagtagtctatagaacgcaggcccaacaatatattgatctgtcaatactcagcaaataaagcctgtgctcacaaaattaatctcagcctaagggcagcccttgtaggaattgtgagcacacccaccccacggatgttgaaattatctcccaggacaaatgagactgggcagaatgttccttggccagttttccttggccattccatcagttgcttctagtccctggctgagagttgggcttgctcaagggtgtctgtccaccccagagcctcatgagccacagacataggattgacccaatgtcagcaatttccctttcctgtggggcaggagaatcagggcaccctgagggatggcacgtggaaggcagcgtggaacccgcctgagagcctgtgtcctgactctgcctgggagcgctgcacttcacccttgggagaacgccttctcagtggctgaactctgcattgtggctgtgcaggctggcttcagacactgttttctccagtgaggcctcttacactctgctcagctcagacctgccataaccgcttgtcggattttctctatttaatgatcaatgtcatatatgtactttttttttttttttttttgagacagagtctcactctgttgccaggctggagtgcagtggcgtgatctgggctcactgaaacctccgcgtcccggattcaagcgattcccttgcctcagcctcccaagtagctgggactacaggcgcgtgccaccatgccgggctaattttttttttgtattttagtagggaggggtttcaccatgttggccaggctggtctcgatctcctgaccttgagatctgcctgcctctgcctcctaaagtgctgggattataggcgtgagccaccgcgcccaaccatatatgtacttttctaatagagttttagattgtttgaacttctgatgggtgagaaaaagaataaggctatgatggtattctttcccttagaacccatatagtttccaaaattcatctttcatgtgctctttatttcttttttagaaacctgggtattattttccaagctttgtgctttttgtgaggctatacaggttctatggtgaatcctcctcatgcctgcgacaacctggaggacattacttgtttttagctgctgataagagtttgcaaagaacacacatctttgttgggaaatgctttgatgtgcttctaggcaagatgaagagtcacatggagtgggggtggtaatttgggagaagggccaagtagcaggggattctcgataaatattaaatgaatggaggtaggaaggaggtctctgaaccacactgtgtgtgggtttaagatcttgctgtgggctttgtggtgtaatgcctcaatctatatcccctactgaagtctatatttgcacttgtgcttttgtgcaaatggggacaagcagaacttcaagacaataatgaatatttcagctacgtttttcctccatgaatcgtgcaaagctctctgaattggcactattactctttcttacttctgcaaccccagaactgcttaatgcagttatattttcctttctcttcccagtgacagatgtccccttattttcctgggcggcaaatgccttcttttccttccttcctccttagaaactctcctgagcacaataagctacagagcctggtggtgggccctatggttggctacataccatgccatcccgggggctcccttttggtttcctgctggtacctgccctcgcctgggatgtcctctttgggttcccatctgccgtgctctcacctggaagccagctctgtgggcctgggagttgccacgattcctaccatggaccctccagctggttcccatgcagcctgccctatcgtcgtgtgcacattcacctgctaggcattctcactatgcagtcagtatgggcctggccttttcctcttccttggaaaatccatctcagtgttttctttttttttctttttaggtagagtcttgctctgtcacccaggctggagtgcaatggtgcaatctcagctcactgcaacctccgcctcctgggttcgagtgattctcctgcctcagcctcccaagtagctgcggctacaggcacgtgccaccacgcccggctaagttttctatttttagtacagatggggtttcactatgttggtcaggctggtctcaaactcctgaactcgtgatccacccgccctggcctcccaaagtgctgggattacaggcttgagccactgcgcccggcccatctcagtgttgtcatctggccctggtgtttctgacatggtgtgtgcgagttcagtggattctaaaaactgctcctctcctccttccccagggctgccctctgtcatttcctatccagcctccctctttccttcctcctctctggcagtaacctcgtacccatcccagaaaggccattgcctttccctggtgacttcctctctcttccctcctcaaggtccttgacgaggtcatcgggagtgtccttgacagctcccctttctttccacattcgtatagtctggctgataccaagatgcaccttttctttttttttctttcaagtcttgcatcacatagatttttctgcaaagccacactgtgccctgaaaccagggatgcctagggctgaaaaccatgtgtgagcttcatactcattagggtgactattattaaaaaaacagacatcactagatcatcagggaaatacaaatgaaagctacagcaagatatcacatcaaacctgttaggatggcaattatcaaaaatacacaagatgacaagtgttgctgagtttggagaaaagggaaccgtggtatgccattggtgggaattaaatttagtacagccattttggaaaactgtggatgtttttcaaaaattaaaaatagaactaccataggatccagcaatcccactactaggtatataacccgaggagacgaaatcagtatgtcaaagaaagatctgtgtttctgtgttcattgcagcattagtcaaaatagccaagttatggaatcaacctaagtgtctatcagcgaatgaatggataaagcaaatgtggtatatttacacaatagaatactactgagccctaaaaaagaaggaaatcttattacttgagaaaatatgggtaaccctgaaggatattatattaaatgaaataagccatgcactggacaaatactgcatgatctcacttatatgtggagtgtaaaaaagtcaaatttatagaaatagagagtaaaatggtggctacctgaggctgtggggtggtgagattagagagatgttggtcaaaggacacaaagtttcagggctggctgcggtggcttaggcctgtaatcccagcactttgggaggccaaggcaggcggatcacctgagaccaggagtttgagaccagcctggccaacatggcgaaccccgtctctactaataatacaaaaattagctggacgcggtggtgcacacttgtaatcccagctacttgggaggctgaggcagaagaattgcttgaacccgcgaggcaggggttgcagtgagccgagatcatgccactgcactccagcctgggtgacagagcaagactccatctcaaaaaaaaaaaaaaaaaattcagttagaagaaataaattcgagaggtttattgcacatcatggtgactacaattaataacaatgtattgtatacttgaaaattgctaagagaataggttttaagtgttctcaccacagaaaactaagtatgtgagagaatacatacattaaatggcttgacttagccattccacaatgtatgcctatgtcaaaacttcatgttgtacaccataaatatacaccatccccctcagtactgtcgtcatgatagtgagtgactttaatttttacttgtcaaagtaaatacattaataaaaaaaaaaaagtaaatacattaataaaaaaaaacccagaaaacaagtgctggtcaggatgtggagaaacgggaattcctgtgcactgctggtgatgacgtgacgtgatgaagcccctgtgtaagcagcgtgacagttcctccaaaggctgaacataaggccgggcatggtggctcaggcctgtaatcccagcacttagagaggccgagacaggcagattacctgaggtcaggagttcgagaccagcctggccaacatatagtaaaaccctgtctctactaaaaacaaaaattagctgggtgtagtggctcatgcctgtgatcccagctacttgggaagctgaggcaggaaaaccacttgaactcaggaggcagaggttgcagtgagctgagatcatgccactgcactccagcccaggcaacagagtgagactccatctctcaaaaaaaaaaaggtaaaaaggttgaacatagagttaccctatgatccagcaattccacttgtgggtacccaaaggaaccaaagtaaagactccaacagatacctgcacacccatgttcctaacagcattatttacaatagtccaaaggtggagataacccaggtgtccatcaatggatgaatggataacaaaatgtggtctatccatgcaatggaatacaactcagccctgaaaaggaatgatgttctgatacaggctacaacatagatggatcttaaggacgataagttaagtgaaataagacaggaacaaaaagataaatactgtatgatcccacttatatgagatacctagtgtagtcagattcacagaggaaaaaggtagaacggtggtcaccaggcatgggcagggcgaatggggagttggcactgaatgggtacagagtttctgtgtgggaagatgagaaagttctggaggtggatgctggtgatggttgcacaatattgtgaatgtacctaatactgatgaattgtacatttaaaaatggttaaaatgataaattgtatgttatatatattttaccacaactaaaaaaattaatgttcaagggtgtccaagcaagaaaaaaacaaaaaccacccatgtgtgctcacgcatctttggcacagatgcggttcctaggttcagctctctcctcaggcattgtctcttcaatgacaacattctgtttccaccaactctgtttctgaaccaaatctgacacagctgtcactggcctactccctggaattaccacaggatctgaattagcctctggcaggccccctgaggaatcttgctttcacgtttccattatggtcagcacagcaacatggcggcctatcccgttttttgtttttttttttttttttttcctgagatggggtcttcctctgttgcccaggctgaagtgcagtggcacaatcttggctcactgcaaactccacctcctgggtttaagtgattcttctgccttagcctcccaagtagctgggattacaggcacacgtcaccagacccagctaatttttgtattttttagtagagatgggttttcaccatgttggctaggctagtctcgaactcctgacctcaggtgattcacctgcctcggccttccaaagtgctgggattacaggcgtcagccaccacatctggcctgcctatccctttgattgaatatcacctgagtaactgatatggtttggatctgtgtctctgcccaaatctcacgtcaaattgtaatccccagtgttgaaggtggggcctggtgggaagtgattggacatgggggtggtttctcatgaagggtttaaaaccatctcccttggtactgttgttgtaatagtgagtgagttctcaagagatctggttgtttaaaagtgtgtagcaccttgggaggccgaggcaggcggatcacgaggtcaagagattgagaccatcctcaccaacacggtgaaaccccgtctctactaaaaatacaaaaaattagccgggcgtggtggtgggcgcctgtagtcccagctactcgggaggctgaggcagaagaatggcgtgaacccgggaggcggagcttgcagtgagccgagatcacacctgggcgacagagcgagactccgtctcaaaaaagaaaaaaaaaaaaggtgtgtatcgcctcccccttctctctctttctcctgctatgtaagatgtgcctgcttacccttcaccttctgccatgattttcaatttcctgaggcctccgcaccctccgccctgagaagccaagcagatacaggcatcatgcttgctggaccacctgtggaaccacaggccaattaaatctctttataaatgacccagtcccagggatttctttacagcaatgtgagaatgaactcctacagtaactcatttgtctttgactttcctctttcttttagtgacagtgtgtgtgcctaagtgactcttgaagaagccttcattcttgaagacacccggtcctcacaggggctcctggggcggtgtctgtggcaggtgaagatgctattgcagaatttatcttccttgccagaagagaacgcctgggcaaaggagaactgccttatagcccaaactggggcccactgtcttttcaggtctctggccatggggcttgacagctggattctaacgtctctctccctagtgcctcccacgtttactctccatgttctgttgattttcttggtgtgtttgcctccccgatcgcatctttgctgtctgctccacactgtacccgatttctgcccctccttgcctctcttgattactcagagcttcaactacctcctcacctctgacaactccgtctattgcttacaggttggttcacctcacacacctgtcacctcatggctgtggcttccgcacctgtgtgcatggcgccctcctcccatagctctcttcccagcacaacctgcagctcctcccgctgcccagctgctccacacgagccgtgattagctcacaccggcctttcctcctccactatcagctcagagccagccatagctcacaactctgagaagtcttccctgagccatacggaggagactgtcgccttcacatttctctcccaggacccttcaagtatagattaggtgctcagcaatgcctttcactgcagtcctcatcctttttcctgtctgcacttctggagcacgggatgcctgcagctttcatttgaaacccctttctatgctattgggacccgctgtgtcttagaattgttttctgggttctaaacttgctccctcctctagtctagagaccaaggactgacatgtaatttgcagttggtatcggtatgtatgagatgtagatgctctagtaacatgggtccggtgatactgacttacatcacgctggattccttccttgcttcatataccctcatgtaactttccgtgcatattttctgcctccttggagaggttgtacccccagagctccaggggaaaagaataactgtccacacagaggtgagtattggtgctttctagccatacactagcatgaggggaggggtcagggaggctctgtccatagaaggcttcaggagtcgcccgttgccatggattctgtgttttttgaatcccagatgcccaggtgagacctctgatttgtgttccccaagaccacagacacatggagcttcctggcatcaggttcccgacaccagagttggggttcctttcaactctattacagtcaacgagcgtcatgctcacggactcgttcagagccacatgctttgcctggccttctgctcacctctgagtggcatctggagaagaggtggcttcatcttgctgcagtcctcccagcgtggagagacctgcactcatcagtgaaatgaatacaacgggaggtgtctggaacctttcttcattttcaccaaaggaatatttgacacacccaggcatggttcagagctccaccctcaacaataatcctgtcaaaatatccgatgttgttgaacctcaaaggcactgtatcacagcagaaaagtgattgatctcattgctaaactctctttcttgcttattggcatgacaacggagctaaatagagccgagatgaattatgagtctatttttggagactccttatggaattcatgcacactgtgtattttgcatcctttgaatccttgggcacacttagaactgtgaagcaaacactcatttgtaaatgttacagctgccaaggttggctgcatgctctgctgggtgacgtgttaactctcacaagtctgctttggaagcaggaggaatgttttgagctgagcttcgggcggagggtggggctgacgcatgcatgcttaccttgaccctgtccatacaggcttccatctttagctgctccacagctttcctggcttgggagatgctagtggtgctgttattagacatgccctctttcattctactgcccctagaagtaaccaaagtaaaagggttagaagagctgctcttccaagggtaggggaaccccacctcccaccacctacagcttctctgtccaagccagggagcatctgggagcatggacagcatttggtagaaaaccctcctgggataagagaaaggaatgcctcattcgagtaagaggagcaagacatgatgcttttgtttggaaaaactttctcagtcccggggacagtgagaagagaacagaaggttccagaatgacttttccatcacccccaccactgccaccaccatcaccaccacgaccataagtaatgcttggacattcgtatagtgctttgagtcatcattcactttcacacacgtttgctcattcattgctctagcagcccatacagttggtgggacaatattaatttctattttgcaaaggaagaaagtgcaaaaatcagagaaattaaaccaatagccaaagatcctacagccaacatttgtggatccagaactcaaactcaaagctttgaagcctagccgagtgtctcaaatggcctctcctaacaatctatggctcataacacacatttctaatgaataaaattgctttattaattttaatttgttgtccttccaaaaagtttacagactttgtgttgagagtttgttttcaacaataaacacacgcacaaacacacactctctctctctttcttccctatcccaagcatagatttattttctagagggaggcagaagaaattctccctaaccctacacacattgatgccccgtgactaagaccagtgtagtgctacctgtttcacagaaagcatgtgctacacacatcacaattgcaattgccccgtctaatgagaatctgcttcaaaggaagcctaaaactaaagcctgagagctggggacaggtcactgagagcagaaacacaagtgacactggctcccaaaggtacagatgaggtgggaagaggccctggccaccatctattattcgtctgcttctgtttatattttatttcagttttaggtttttttcccacctcacaactgttggactttattgtattaatttaattgagtatgtaaagcagcaaccatactttcaaagttaaaatgatgcaaattgatattcacacaggtgtcactttcactgcccattccaatccttttctcccctcccacctacctcctatgggcaaccaatcacactggactccagtctattctttcctatgcttcttttttctccttccttccttccctccctccttcccttcctccctccctctggtcttccttccttcccatcacgttggactccagactattctttcctatgcttctttttccttttcctttcctttcctttccttccccttcccttcttccttccttccttctttttgagatagggtctctgtcatccaagctgtaatgcagtggtgcaatcacagctcactgcagcctcaaactcctgggctcaagcgatcctcctgcctcagcctcctgagtagctgagactacaggtgtgtgccgccatgcctggctaattaaaaaatttttttttgctatgtttcccaggctggtcctgtgtttattttcttagaaagtaagcagttacatatatgttttctcatttctccttctttcttacacaaaaagataacgtgtgtgtgcttttgaactttgtttttatatttagcaatacattttagaaagcaccacatattagttcactgatatgcaaaaaagatcatactcattctttcttagaactacatactacagtactccactgtgtggatatactgtatatttttcaatccatatatttacgggcatttacatctatattctcatattattgtgggggtgtgtcttcaaggtacatttctggaattactgggtcaaaggtaaatgcatatttacttttgtgatatattaccaaattctataaggtaacattctgataatttttgcatcaagattcttaagtaattttggaattcagtactattcttaagtaataaattaagtcatttaatgctaccttcatctggtttaaatatcaatgttatacttgcttcatacaaaacatttagaatttttaagaaattttctatttggccagtaggttagtgtatgggacccactctctctgtgggttttaatcacatatgaactaattctctggcccagaaaggcataatggcaactacatttgtccaaaggcagtttttgaaaagtaaaatattctcgttagaagacagatcagccacccaaatcagagtttaatagatgtgtgtccttatcttagtttggaactttaactcaacaacaagggaaggagaatcacgacaagttgggagctttgaaatccaaggaacatccccttcatcccccactcagcagaactgtgcacgcgttcctgcacatgtgttggtgtgtccttgggtgtgtctgtatgtgcccacgtgcctgctcgtgcaggccttgtgccagtctgtgtgtggccatctctccgtgtgtgtgtgtgtgctgatgtgtgtctgcgttgctgtgtgtctacacaaaatgagggaggagacacagtctagttcccaacccttcccagctgatgcaatgaaaaaaggactctgatgtgatttggatgtttgttccctccaaatctcatgacgaaatgcgattcccaatgtgggaggtgggtcctggtgggaggtactggatcacggggccagatcagtcaggaagggctcagcgccaccctttggtgataagtgaaagtcactctgagttcatccaagacctggttgtttaaaagtgtgtgtcgccttcctgctgtctctcttgctcccactcttgctgtgtgatagtatggctcccccttcaccttctgcatgagtggaagcttcctgaggcctcaccaggaacagatgctggctgccatgcttcctgtaccacctgcaggaccataagccaattaaacctctttcctttagaaattacccagtatcaagtattcctttacagcaacacaaaacagcctactacagaccctacagtgactgccttcaaatcttgatcctgctctccccattctagactccatccctctcgccccttgtctttgacttgggcatttaggagttgggggaggttcaggggaggaggaggtagagtttgggatcagcaggggtgaagccaagaggacatggagcagggcaaagggaggaggggagggctctgcactgtgtgtgagggagtctgtggtgagtaggagtgtgtgaaagtgtggggtgggggtgagcgtgtgagagtgtgtgggggtgagtgtgtgtgacagaaagtatgtgtgagggtgtgggtgagtgtgagtgtgtgaggtggggtgtgtgtgatgacagtgtatgtgagtgtgtgtgaaggtgtgggttggggtgtgtgtgagggtgaggggtgtgtgtgtgtgagagtgtgagagcatgtatgagggtcaggggtggggtgtgtgtgagtgtgtgtgtgagcacgtgtgtgagcatgtatgagggtgaggggtgggggtgtgtgtgtgagggtgggtgagcgtgtgtgagggtacagggtggggggtgagtgtgagagtgtggatggggggtgggggtgtgtgaatgtgaggtgggtgtgttgtgggtgtgtgtcagggtgtgggttggggttgtgaatgtgggagggtgtggggtggcggtgagtgtgagtgtgggagggcatggggtggggtgtgtgaatgtggggtggagtgtgagtgtgggagggtgttgggtgtgtgtgtgactgtggggtatgtgtgcgagtgttgggtgtctgtgtgtgagggtgtgtgtgggtgtgggtcagggttcagggtgggggtgagggtgagtgtgggagagtgtggggtgggggtgtgtgtgtgtgtgaaggtgagagtgtgaatacaggcacgtctcagagcatgcggggtgaacgtgtgtgtaagtgtatggagtgtgtgagagggtgtggggggtgtgtttgtgtctggagtgtgagtgtgtgggtataagtgtgagtccttgaggatgtgtgcacatgtgcacaggtgggtcatgtggcggggagggaacagctaacgttaccggggaaagcagcagagccgactctcagtcccgtcaggcccctgcagctgcgcccacctctctccctcccaggcgctgttcagacggccctgatccctcagcccttcctcattcttccgctgttcaaaagaagggctcgttttccacatgccctaccctctccgcagaggagagttctggctggaggcttcctgtgggaaggtcccaccagcgcactgtgctttccttgttgtgcgctggagataaaataagcgggtgggtgaccctctgggggttccatccctccatggcctccctctcaggccctccatgtgcgtccactctccagcccatgtctgccacccacagccgaggcccctggacctggcccccagcgggggctgtgctctccgaccccagcttctccctcagccccttctctgctgcttcctcctcccctggctccatacttagcctcaacagcatgacccaactaccaccactgtctcccaagagccgtctgcttctctggccctttcctctgtccctaaaacctgcttcggtatggacccaactcctcccctctccacactcacgaaggggctgctcagcgctgctggagagaccccccccactaaactctgcccatcagacatccacaatccagcctctgcgaggccctcagagctacctggcaataggactccttgccccaaatcatctccccctcccttcatcctcttcttccagtcttcatcacttcctcatcacctctgacctttcctcctcagcagaggacctcagcccctctgtctacacagaatggccattagcagagaaccctccttaatgttccccaccccacctactccactccacacccacatccatccttgcctccactcagggcagcagctcttcctccacagcagagcctgtaggacaccacccacagctgctcccgacttgctgccctgccggcagggccctccttcctccccaggggctgacaatggcagactcactttcttgcctcccttgctgtaaggccagagcacgcgtgtcaggaacatggctgtgctttggtcaaggataggctgaggtaaacatccagagtgactcagcaagtttagagcgcaggcgtataactccacttgtcatcacagccatatagccataacatcggaaggctcatcatttggctctaagccactgttgtttgtaaaagctattattgccctgctgacactgtacaggcatgctggcgcccagagaaagagccaaagctgtccattttgcaggtagacagggggagccagggcacagcacagttcagctcgtgcccagagagagaaagagttaagctgctgaccccgaaggcaggggagagtcggccatgcagctatgtgtgggagctggctgctgagaggagccacaaagccagagcagacagctgagtcaaggcggacagtgtgagagagctggtatgagtcagctgctgagagacctgttgagtaaaactacatttcacctgcttatggccccacgagtgttccttcagctacctgcccatccgcccactcccctcgaacctcagcatgggctggaacctgaccccaagcagggcatttggtatagttgtgaacctgacaacgtgaccttgtcctcctcaatgggacatcaggggaaatctgcagggactcatagggagggttttcctccccgacggagggacaaggggagaaagctctgtctttggccaccttgagttgtgtttgcagctgccagagccataaaaccactggggaatcaaccaaggacacggtcactagtctagtggagaaaatgacctggatccttgagctgggtgggtccttggaagtctattcctgatccttgaaatgagataatgtactcctcatggttcaggccatatttgttgggtcatctgtcacttgcagctgaaggcatcttctcagccaaggctaacacttcacaggtcagtagaccgctcccctccccaagggatctgccctacactcacccctccatcctgtaatgtccacgtctctggcgcttttcctcctcagaatatgcaaatatatttatgcaatctgcacctgaccatcttaaaacaagcaacaacatcaacagtcttccctccctgcaatcttctgcattcttgcttaagaaggtggagaggctgggtgtggtggctcatgcctgtaattccagcactttgggaggccgaggtgggtggatcacctgaggttaggagtttgagaccagcctgaccaatatggtgaaatcccctctttactaaaaatacaaaaattagccaggcatggtggtgggtgcctgtagtcccagctacttgggaggctgagacaggagaattgcttgaacctggaaggcagagattgcagtgagccgagattgcgccactgcactccagcctgggtgacagagtgagactgtctggaaaaaaaaagaaggtggagaggtaaccacagattcccctgagaggcccctcagtaactaaaggaagagattctaatgtaaggatgaaaagccgtctttcgggagcactgggtaaacaggcctgctccacggtctctgctctgctgccctcggctcaccctgattctgtgtctaggacagtcacccttgttgcccagagtgatccttaagcgatttcatgtgtgcgtgtttgtgttttctctctccaaggggctgctctggcttctcccagcactgtggccctgcacacctggacgtccgtattttacaatctcccaggctgattctggcccgtaccaaaggagagcaccactgctggctgtgagccacttctacttcgtgattccttagtgtccaaattaccttgcatgggacgcataggatgtctcatgtaccttaggggctgtctcaactagtcctttttgaattttaacgtgcatatgaatcacctgaggattttaaaatgcagattttgatcgagtggctctggggtaggggccgagatcctgcgcttctaacgagcttcgtgaggctgctggtccacggaccacactttgagtagcaaggctctgaatcactgactgttggtattgcaggggaacatggaggtccggttccaatcctcttatttttcagataaggaaatatattcaaggaggttaggtaacataatttcccagcgctcctcagcaggagtggaaggaagcactgctccgccactgctcctggctcattacccaccttggcctagtggcgcttaggatttcatcccccacacttggtctgtcctgctctcctggaacagactcatcccctgggtgatcctaaccttgcttaacctgggagtgaggtgtcaggagggagccccttccctgaggtgggcaaaaaaagcaggaaatccctggtgggggagaaggtaatggcttttgccaatggtgctgaagacaaccacatgctttgaagatagagccctataagaaggtttcggaggtcctgcttcccctacctggccaggtaccctttaggctccacctgaataacgcccctgcctttctgagactgtctggatgctatatgtacttccatggggactcaggtatgcctccctgcacagacattcatgcgtctgcacatcccacctggacccaagaagaaaaatggaagtaggaacagagaggagctgcaacaaatctccacacgcacactggctaccggcaacactgactgggctctcggctttccagaagatgaggcaagggggaaaagggaccatttgcttaggggtggcacctggggccacgtgctcacacagctctttcttcccaggtatacaggaatgtgctcatgcacataggtcgcaccgggggtttcttgagatgcagcagagaacccgttgtacgggtctgtgggacccccagcagggaaataaaggaaaatcttgagttccttcaagggaaattccaagctagcaccaagttagccctgagaagtaaataagtgacttgataagcaagaaggtaatagtagcttaaaacaatagccaaggaagctagaattacgagatgtttggtttccctatagaaactaaagataacatcttaacatatgtctctgagttgtttttcagaaacccggccccctacggaatgaatcagctggcacagagacctcagatgagggggaactgaggactcaactctgactgctgcttttggttctaaatttcttcctgggccgggtacagtgactcacacttgtaatcccagcactttgggaggccgaggcaggtggatcacttgagatcaggagttcgaggccagcctggccaacatggtgaaaccccgtctttactaaaaatacaaaaaagattagccaggcatggtggcacgtgcctgtaatcccagctactcaggaagctgaggcaggagaattgcttgaacctgtgaggcacaggttgcagtgagccaagatcacaccactgcactccagcctgggtgacagaatgagactcttatctctaaataaataaataaatttcttcctgagggtcctggagggagtcctgcccacaagccagagctaacattttttttgccgaccccaacattttaaacaaagcttcttttccttaagtgattgcaaatcagaagatctttaaatccatccacgacctgtaacccctggcttgaagatagccgcccttttcggtcaaaaccactgtgcaaccgccatgtgtcgattttacaatcttacctgtaacttctttcctgaaatgtacctccgactttaaaaacccttacctgcaagctactggtcaggatttgagcatgagccgccgggtcctccttgcttggtgcccagcaattaaacaccctcctttcttccactgcaacacctcggtgtggatatctggtcttaccacgctgggcaagcagaccccggtttgctctgtaacattttttttttttttttttgagatggagtcttgctcttttacccaggcttggagtgcagtggtgcaatctctgctcactgcaacatccacctcccaggttcaagcaattcttctgcctcagcctcctgagtagttgggattacaggtgcgtaccactatgcccagctaatttttgtatttttagtagagatggggtttcaccatgttggccaggctgatcttgaactcctgacctcaggtcatccacccgtcttggcctcccaaattgctggaattcaggcatgagtgcctgcatccgaccatgctctgtaaaattctgatgggctgcatcttgcagcacacaactcagtaaatacaaagttggggctgggagaccaatgcaaggcggttccatccccagtgcttctgacctgacctgactcacggcacagtacttagaatttctggaagccaaatgtcattgtgcctttgcagccatcctccccaactacgacttctgtccatgagcacttgacaagtatctgtaggcagaatactacagccggccttccggacaatgcccaaaagacagctgggtccggaattggtgggttcttggtctcaccaacttcaagaatgaagctgcggacccgcgccgtgagtgttacaattctcaattcttaaaggcggcgtgtccggagtttgctactgctgatgttcggatatgtttggagtttcttacttctggtgggttcatggtctcgctggctcaggagtgaagctgcagagcttcacggtgagtgttacagctcttaaggcggcgcgtctggagttgttccttcctcccagtgggtttgtggtctcgctggcttcaggagtgaagccgcagaccttcgtggtgagtgttacagctcataaaggcagtgggggcccagagtgagcagcagcagaatttgttgcaaagagcaaaagaacaaagcctgcacagcgtgcatggggacccaagcagattaccccagctggcgcgggcagcctgcttttattctctaatctggccccacctacatcctgctgaatggtccattttacagagagctgattggtctgttttacagagagctgattggtccgttttgacagggtgctgattggtgcgtttacaatccctgagctagacacaaaagttctccacgtccccactagattagctagatacagagtgtccacacaaaggttctccaagtccccaccagcgtagctagatacagagtgtcgattgatgcattcacaaaccctgcaaaccctgagctagacacagggtgctgattggtgtgcttacaaaccttgagctagatacagagtgccgattggtgtatttacaatcccttagctagacataaagtttctccaagtccccaccagactcaggagcccagctggcttcacctagtggatcccatctggggccacaggtggagctgcctgccagtcccatgccatgcgcccacactcctcagcccttgggtggtccatgggactgggtgccatggagcagggggcggtgattgtccaggaggctcaggccgtgcaggagcccatggtggtggggaggctcaggcatggtgggctgcaggtcccgagccctgccccgcagggaggcagctaaggcctggtgagaagttgagcacagcagctgctggcccaggtgctaagcccctcactgcccggggcttgcgggccggccgctcccagtgcggggccgctaaacccacgcccacccagaactcacgctggtccgcaagcaccgtgcgcagccccagttcccgcccgtgcctctccctccacacctccctgcaagctgagggagccagctcccgccttggccagcccaggaaggggctcccacagtgcagcagagggctgaagggctcctcaagtgctgccaaagtgggagcccaggcagaggaggcgccgagagcgagcaagggctgtgagggttgccagcacgctgtcacctctcacagctatccctgagcctgaagggacccagcagcttaaactgcgagtggggaggaagtgagtggtggacctcctttcatccttgctgaacaaggaagctcactgcaatagcatctcttttcccacagggaagcacacagcacggttccccagccaaggcccagcagccctcggggatggctcagttctcctcccctgctcccccaacaggtgcacatccattcacataggggataacaggaggtggcaaaaggtttctaagggccccgtgtctgccgtggagggtgggagaaggggacaggacagtgatgattgctagaagaaagtgatgctgtgaggacctggccaccatcaaggatcctgagaactgagtctcaccccagcccacacacatgctcctggcgaagacacctgctgtcctcctgcccctacacagggtaagtcactctccttacctgctgagaggcagccgtgtgacaggcctgggcaagggacagaggctggcggtggcagcagctgtcagtcgtcagatgagaggtgaattcagagcttctgctttgaggtcacctgaaagcacaaccagagacatgtctagaggtgtggggactccctggcattgctcccagagtccccatccaccctgtcccatggttcccctctcctcaaactcagcagccttccccaaaagcctggggactccatatcagaccttggggagatggggagctcgaggcagacagagaaccctcagatctgacccagagcagactggaaacacaacttcagggccacaggccaccccgggcctcaccagactgctcccctggaccctgcaaaccttcatgcccagtcgctctgccccccaacacaaggagccccagctccagccaaacctatgccaaatggaaacaggtcacgtgttttcttcttataaaaatatacacttggggccgggcgcggtggctcatgcctgtaatcccagcactttgggaggccgaggcgggcggatcacgaggtcaggagatcgagaccatcttggctaactgggtgaaaccccgtctccactaaaaatacaaaaaattagccaggcgtgatggtgggcgcctgtagtcccagctacctgggaggctgaggcaggagaatagtgtgaacccgggaggcggagcttgcggtgagccaagatcgctccactgcactccagcctgggtgacagagcgagactctgtctcaaaaacaaaaacaaaacaaaaacaaacaaacaaaatacacacacacacacacacacacacacacacacacacacacacacctggccgggcgcaggggcttatgcctgtaatcccagcattttgggaggccgaggtgggcagatcaactgaggtgggaagttcgagaccagcctgacaaatatggagaaaccctgtctctacaaaaaatacaaaattagccaggcgtggtggcacatgcctgtaatcctagctagttgggaagctgaggtgggagaatcatttgaacccgacaggcagaggttgcggtgagccaagatcatgcctgggcaacaagagcaaaaaacaaaacaaaacaaaaaaacacctattatcaaaaaatgtgcagataaagataattacaacaaagaaaataaagaccagtgataatgccttttcccagagataactatggttagcctgttgatgtataatatacttacatgcattagaaatttgatttcaaccaaaggacatttagcatagaagagatcagacgactcgaaagctctttttttttaatatttattttttgagatagggtctcgcttcgttgcccaggctggagtgcagtggaaaaatcacggctcactgtaggcttgaactgggctcaaacgagcctgccacctgagcctcctgtgtagctgggactacaggcgtccactaccatgcctggctaatttttactttttttttttttattttgtagagacggagtttcactatgttgcccaggctggtcttgaactcctaggctcaagggatcctcccacctacggcctcccaaagtgctgggattacagccatgagccactgtgcctggcctttgaaaggtttcttacagcccattcaagactcatagccctgttcgccttccctttgcagccatcctccgtaactgtgacttctccaggacagtctctccaggatggctgactctggggtaatgagttcattccccaagggttttccgaatgctctgccctacggcatccatctccgaggcatcctaatgaacttggagcaaagctaaaagcccgacaagaataagctgacagacctgtttgctcccctggctaaaatggaatccaaattcattttggcctcaacttcaggggagatggtttgaagttgtgcttggtgcatttttctcagcctgtgctatggtcagaatgtttatgtcccccctaccccccccaaattcctatattgaaatccaaagccccaaggtgatgctgttaggaggtgggacctctgagaggtggttaagtcatgaggatggagctcttatgaatgggactcatgatcttgtaaagagctctgacagagatccaggaatgctttatgttttagtttgtttttttttttaacttgtttgctgtgtgtgtgtgtgtgtgtgtgtgtgtgtgtgtgtgtgtgtatttttttttttttcagatggagtctcactctgtagcccaggctggagtgcaatggtgcgatctcagctcactgcaaactctacctcccagattcaagtgattctcctgcctcagcctcccaagtaggtgggattacaggtgcccaccaccacacctggctaattttttttctatttttgtagagacagggtttcaccatgttggccaggctaatcttgaactcctgacctcaggtgatccactcacctcccaaagtgctgggattacaggggtgaaccactgcacccggagttggttttgtattttaatataacagtgcttcttctacttttccaccacattctggggaaaacagaaccactgaggcaactggcttccctgactctggctacccaagaccccacccagagggctgaggtgctggatcaaggctgtacctgtaggttgcacactacactccccagcccactgtggggaagctgttctctaccatcggttccccaaatttggttgggatcagaatcctctgggaatgtacagagactaaggccctgctctacccacctccatgaccttagagttctgtcttagctctcttggagattatgataaaaccactgctctataggcaaccagagcttctcagactttgctgtacatctgaaccactagggggacttttaaggatcccgattccagctgggtgcagtgactcacgtctgtaatcccagtgctttgggaatctgcagcggaggattgtttgagcccaggagttcaagaccagcctgggcagcacagtaagaccccatctctacaaaaaatttaaaaattatctgggtgtggtggcacacgcctgtgatcccagctattcaggaggctgaggcaggaggatcgcctgagcctggaattttgaggctgcagtgagctgtaatcatgctactgcactccagcctgggcaacagagaccctttctcaaaaaaccccaaaaatataaaattaaaaaaataaagatcttgatgcccaagtcaaaccccaggccctttaagccacaatctctgggggaggactgaggcatcagtggaagttgaagcttcccaggtgatttttttttttttgagacaggctcactctgttgcccaggctggagtgcagtggtgtgatctcggctcactgcaacctccgactcctaggttcaagtgactctcctgcctcagcctcccaagtacctgggattacaggtgcatgccaccatgcctagcttaatttttgtatttttagtagagatggggtttcaccatgttggtcaggctggtcttgaacccctgacctcaagtgatccgcctgccttggcctcccaaagtgctgggattacaggcatgagccaccacacccggccttcccaggtgcttttaatgtgcagccgcgtttgagacacactgctcaagtctgcatctagctggagcatcccacactttggtgtgtatgtcatgaaacccgtatctcaggctctcactcaacaggactggctgggacctcggggaggctgcatgctgctactcacagcctggtgggagacatcagcttcagtatcccctggagctcgttagcaatgcagaatctcaggtcctacccaaacctacgaagtcaaatctgcgggtttttttgttgtcgttgtttgttttttggtttgttttttttttttttgagacagagtctcgctttgttgcctaggctggagtgcagtgacgcgatcttggttcactgcaaccgccgcctcccgggttcaagcgagtctcctgcctcagcctcccgagtagctgggattacaggcgcgagccaacacgcctggctaatttttgcatttttagtagagacggggtttcaccatgttggccaggctgataacaaactctgacctcaagtgatccgcccaccttggcctcccaaagtgctggggttacatgtgtgaggcattgcacccagccgaatctgcgttttaacccaggtgattcaggtttacgttagagtttgaaaagttctgagctagaccagcagggcccagtcctgccttatgcagggtccaagatgaagagcctggctgaagacacgtgggtcagtcataacagtggtggacagcagaggtgctgttctcctgacccttaatgttattcacagccccatcagctttttagattcctcttttagataacttactaactctagaagctctttgagaggccacacatcagaaaagacactatcaatttctccttgtcctcctggcatttgcatagcatcttccatccaacgcttgaaatgtatttcagatgtcaacccaccagcctaccccaggaagtgattttagacaccttccctgtatcattgctatttctcaaaataacacagattgttggagctgatgggaatttagctcttgactggattcctttatctggttgcggaagaaagctttttttttttttttttttttttttttttagacaggcagagtctcactctgtcgcccaggctggagtacagtggcacgatcttggcacaccacaacctccacctcctgggttcaagaaattgtcctgcctcagtcactcgagtagctgggattacaggcatgtgccaccatgcccagctaatttttatatttttagtagatatggagtttcaacatattggccaggctggtcttgaacccctgacctcaagtgatctgcccaccttggcctcccaaagcgttgggattacaggcgtgagccatggcgcctggcttttgtgtgtgtgtgtgtgtgtgtgtatatgtgtgtgtgtgtaagagagagggtcttgctctgtcacccaggccggagtgcagtggtgcaatcatagctcactgcagccttaatctcctgggctcaagtgatcctccaacctcagcgtctggagtagttaggactacacccagctaatttttaaactttttgtacagacaggatctcactgtattgcccaggccggttttgaactcctggctcaaaggatcctcccaccttggcatcccaaagcattgggattacaggcatgagccaccactcctggctgaaagctgctttttaatagcactaaattttaccatgatgttttcaaaagcttttcttccctctcaaaagaagaaaatatattcatctttgaaaaaattgctgtgtttcattgtgaggtagtgggaaggcccactggctggccatgagctaactgggagcccctcaagggcagaggccttgttttttttagcttctgtgcccccattgccaagatagggcgggcacgccgtagccagtccctatgaacgtgactctggtgtgcatgaaagaataaactgaggcttcaacagagactttaattccccatggctgctgctgtttcagttcttaaatggagctaaattaactctgggttgtgaagggtaatgacccagagtcatgcagatgtactgatggctccaacaacttccttactttgagaaacagtgatgatacagggaaggtgtctaaaaccccttgttagggtatgggataggctggtgggctgacatctgaaatacattccaagcaatggatgaaagatgtggctactagaattaattaaatcatctaaaagaggagccccctagtggtgctcggctttgaggcacaggtgtgaggtctctgctctcacagagcttactgcctggtgaggggcgccatggactgctggaatcaccatgctgatccatgaatattcttatgagggaggcgcccggctctcagtgtataaccaaagaacttgacctggactttagcatctacattgctttctatgatagattctgaagccgtaagatggaatgagacttgcccgccctcaaagagctcaggtgctgagggagagatgtataaataagcaatgatcatattgtcatgggtgtatgtgggctggctgtccacagaacccatgctccccttcctctcacaggaatgtcatggtgacagggcaggtggcccctggatagatattccccagggtcgcttgcagctacgtgtggctttgtgactcacgtcttgccaatggagatgccgacgatgaatgagtggaaatgatgggtgccgcttccaggcctgggctttcagatatcatttggggacctctgagctctttcccatcacacgtggatgtgtctacagcttaagttcaacaagggcaggcgaggacagtggcctgagtggtgcctccaggtgtggtccctggaccggaggcatcaatgtcccctgggaacgtgtcagaaatgcaaatgcttgggcccactcagacctaccaaaatagaagctctggggccaggcacagtggctcacgcctgtaatcccagcactttgggaggccgaggcgggtggatcacctgaggtcagaagtttgagaccagcctggccaacatagtgaaaccccgtctctactaaaaatacaaaaattagccaggcatggtggcaggtgcctataattccagctactgaagaggctgaggcaggagaatcacttgaacccaggaggcggaggttgcagtgagctgagatcgcgccattgcactccagcctggtccacagagcgagacccgatctcaacaacaacaacaaaaaagaagctctgggcgtgggaaagtgcttaacaaggcctccaggtggttctgatgctcaagacaatctgagaagcacagtcctgggggacgagagagaaacaaaacggaaagagcccacgtccccaaattccccctggagctgagcggccccgttagcctggcttcttacttctgggctcatatgagaaagtgaaatacatttccacactctttaagtcaccgtgtttctgcgtctcttggtcacagcagctttgcatctcactaaccgatacagtatttcaacagaggttagtatactggatggctgccttgaaaatgcttttaaacctgagacagaagtactcatttaagagcttgtatttgggaaactcaatacaatgaggcactcaggtctaacaaggattccacctagtgaaactgtgtttatttctagggtctaacattttaccctaaaattctgttagatgctaggcccaccagatagcactgcttttgcaccaacattcaggctgggttctcctagcgttcatcgtgagcattaagattcccccctttcagctgtaagaaaaattggctttgaattgtcacaagaatttcactaactgagttgacatcttggcattccctcaagaatagaggtcacgttcgcttccacacagggatctaaaagggaggggagggccgggtgcggttgctcacacctgtaatcccagcactttgggaggtgggcaaatcagttgaagtcaggagttccagatcagcctggccaacatagtgaaaccctgtctttactaaaaatacaaaaattagccaggtgtggtggcaggtgcctgaagtcccagctacttgggaggctaaggcaggagaatcgcatgagtctgggaggtggaggttgcagtgagcagagatcgcgccacttgcactccagcctggacaacagagcaagactctatctcaataatgataataataattaataataataataataataataataataaaaggcaggggaagtcctaattcacctggatgtcataatcgctgtggcagcaaagggcacagcctttctatctgtacacgtggatgtgtaaggtggcattttagcaccacatgatcaattctgctgtttctcagtcatcctaggctggagctgaatgtcctgacccctgaagggagtgcagggaacgaggtgccctcccacccagacacccagggctctacgtttgcagtaggaacaccgtccccctcgcagggggatgactcttccccactccgacttcaaccactttgcaaattaagtactgtgataggcaagcttgatacattttacagtatgggtctcaattactcaacttacatcttgagtgcccgatagcatccagctggtctaataacacctaatcacacagatgctaaacaagtccagggattcgaagctttgggcagggcatgggttgtaatggacttgagagacaaccacagtttcttaggaagagcacgcggggtccgaacgacgctggggcctgctggtcacctgtcaccttatctggtccttattaaggtcaagaaaattagagaaggttggcagaccagcggttatacttaagaacatttgacaaattagtgcagaataaacaacagaaagagaaactagatccaccttccgtgggacccttcacgctatccactccctcacctagctggccacccagacactccctgaccattgcttcggccttgcaggtagaaatcaaaactcttaatcaacaggagaagatgttagaagtttactcgtggcctgaggctcttacatcagcccttactgactgtgatgttaattctttctgactgctgggttattcaagttactcaaactggaccacggtgttgaccggcacgtatggaggaacacaaacctgtgtctggtgtgtttgtacagtctataaaccttacagtctagaatgaattcattgtcattcgagtctatcgcagctctactgaagtgggcagatcaccacacgggggacgaaaaggtagttgagcgatggcgtggctgggccacgtctcagcttcctagagctgtgggaacaaattactacaaaccgtgtggttctaagcaacaaaaatttattctctcacagctccggaggctggaagtccaaaatcaaggtgttggcagggtcacgctccctctgaaggccccaggagaaaatccttcttcctcatcttttcctatcatctggtgacctctgataacacttgacattcaatccttgatttgtagacatcactccaatctctgcccccatcttcacataacccacttctctgtgtctcaccgtgtcatcttcgctccttataaagataccagccattggtcttaggtcccactttaatccagtatgacctcaacttaatcatatttgcaaagacccactttccaaataaagtcatattctgaagttctggatatatatgaattctgggggtaaactctgaactcagtatagtcaggaacccagaaatgtggccacaagtctgtgctcactactacaaagaatcagattttgttgttgttgttctttgtaatacctacaagaaacgcctctctgacaattgtatggcgtttcatggctgtgggagaggaatgtatctcagggtgatgggagcatgaactgagaagcagaatttataacctatactcacctcaatttttttcacttgtaaaatgagaaaattgagatccggccagctaagtcatttgtccaaagccattaaatagctaataagcagcaaaaataaggtgagaaccccatatcattcattcattcattaaacacatactatgtcaggcatctcactgaagaaatgaggaagtgggtggaggtggaatatgattcctgccttttttttttttttaaatggagtctcactgtgttgcccaggctggagtgcagcggcacgatcccggctcactacaacctccgcctcccaggttcaagcgattctcttgccttagcctcccaagtagctaggattacaggcatgcgccaccacgcccagctaatatttgtatttttagtcgagatggctaggctggtctcgaactctggacctcaggtggtccgcccgccttggcctcccaaagtgctgagattacaggtgtgagccaccgtgcctggcccgtgattcctgccttctatttatgtggagacaaaactaacagcagcaaactcaacaatcaaatcaaggtgctaccacagaggtcagtaaagggtagaggggccaagaaggagatgatcgattcaggtaaggagaaggttaggaagggctttatactcaatttgagcctaggaagatgaatgggacccactaggcactgtgatcagagagggggagttccaggcagaagtcccatgcaagtgtggtgttgcagcatgggtaaagacggagcaactgagaaccagcctggcactttcaggaaaccctgggtggtcccttattcctgaagcccaggaggtcagggagcagaccaggaagggccttgagtgccacactaagagtgtgggactggtatcatgtaggcaggtgtcatcaaatgaagggttatttaacagagaagtaaaaagattgctgttacattttatttttttgattgagagtgtgggggggtgggtctcactgtgttgcccaggctggtcttgcactcttgggcttaagtgatcctctggcctcagcctcccaagtagctgggattataggcgtaccaccatgctctgctgttacattctagaaaggtcacttcaacctagtgtggagaatggatcagaggtgaacaagataaacaagcagaccgaggtgggcggatcatgaagtcaggagttcgagaccagcctggcctgaacatagtgaaaccccatctctattaaaaaatacaaaaaattagccaggcatggtggcatgcacctgtaaccccagctactcgggaggctgaggaaggagaatcgcttgaacccaggaggcagaggttgcagtgagctgagatcgtgccactgaacttcagcctgggcgacagagcaagactccgtcttaaaaaaaagaaaaatcaaacagaccaatgaggaaaccatgggagtctagatactggctctggtagggagacggggtggagagccaggtggtgagggtggaagagccaggggatgtggttaggatctggatgctggggaggggggaaaggaaggcatatctgggctgaccaccagggagatggtgctgtgctgttccgcacgcttaggaaaagagcaagtggaatggggtgcagagttcacatagggccaggctgaacttaggaggcctttgggaaactgagaagcacatggccagcagacaggaggactgatagagatggaattcacagggagtttgggctgaagacggagctgagcaactcatgacttgtaggggcaggggaagtcctggctgtgggaggctcatgggccagggggagcatgggtcagaaggctgggctgcgtgcagagcctttggcccaaagcagcatgggggggcgagcagaggaaggaagccgcatgctcacttctccagtagctagcttccttccttccttccctccctccctccttcctttctttccttttttttttttttttttttgagacagagtctcacccaggctggagtgcagtcgtgtgatctcagctcactgcaacctccgccttctgggttgaagcaattctcctgcctcagcctcatgagtagctgggattacaggtgcgcaccaccacacccagctaatttttttttatttttatttttagtagaaatggggtttcactatgttggccaggctggtcttgaactcctgacctcaaatgatccccccgccttggcctcccacagtgctgggatgacaggtatgaaccatcgcacccagccctgaaggtttctttctatgttcttcaatctgtacttttcagatttgtggaggtaaaagattacttagtgccaataaaactaattattctttccagaccaaatattgaaatggtgctaaatggagaagtgacagatgagctatggtgtcaccaccaacatcagattacacagcacggatggacagtgtgttgttcaatgaggttgctggccatcgccactgggtgcaccgtggggcctactctcgggaggcagccgcctacagcggaaagcatgcagacaagtggttctgtgaattatctgaagcaaatgcattgtacttcacagactctgtagtagaaaaccaccagtgtgaatttagtgggtcacgcgctttgatcagggagaatgagttcgcagcagttcatccatccacgccgcccagcctgactccctttcatgccatcccatcggcacggcttttcagtattcttgctagggttagggtgcagcctcctacttcagagcaaagccacaagagcagaagtcatgaggccaccctccctgcctctctccgggagggtgtctcctgcccagcacagggcccagccccctcccctcactttagtccattctgatgtgggactttgaggctgtccaagaaagatgaggtgactccatcctctgggaccagctacaggaaatgctgtttctattttttttttttttttttgagatggaatctcgctctgtcacccaggctggagtgcggtggcgtgatcttggctcactgcaacctctgcctcccaggctcaggccattctccttcctgagcctcctgagttgctgggactacaggcgcacgccaccatgcccagctaatttttgtatttttagtaaagacacggtttgaccttgttggccaggatggtctcgaactcctgacctcatgatccacccacctcggcctcccaaagtgctgggattacaggtgtgagccactgcacctggccaggaaatgctgtttctaaaggctgctgccagctgctgccaactatgttttatcacttaccatttcctttttaaaaaaataccaaattcacattgaaatgcttgaattaaaaaagtattgaggttcaattcacttacaataaaattaatcattttaaaatgagcaactcagtgacgtttagtacatccacaatgttgtgcaaccaccaacactatttagttccaaagcacgtccacaccttcagaataaaacctcattccattaagcagttctccattaagcagttctcttcacttcccgctcctcccagatcctggcaaccaacagtctgctttctgtctctacagatttacccattctggacatttcacataaataaaatcacaaaatatgcagtcttttgtgactggattcttcctttgttttcttttttacttagttttttattttttattttttttttttttgagacggagtctcactctgtcacccaggctgaagtgcagtggtgcaatctcggctcactgcaacctccgcctcccgagttgaagtaatcctcctgcctcagcctcctgagtagctgggattacaggtgcccaccatcacgcccagctaatttttgtgtttttagtagagacggggttttgccatgttggccaggctgatctggagctcctgagctgaggtgatccacccgcctcggcctcctaaagtgctgggattacaggtatgagccactgtgtctggctcctcaatttttttttgttgttgttgttaaatagagacaggggtctcacattgctgtctaggcttgtctcaaacacctggctccaagcgatcttcttaccttggcctcccaaagtgctgggattgtaggcatgagccaccgcacctggccagcttttttcacttagtgtaatgttttcaggattcatgcatgttgtagcatgtatcagtatttcattcccttttatggctgaagagtattccatgatgcaggtgcaccacatttagtttatcggcccatctgctgatagacatttgggctgtttccatcttttggctattgtgaataatgctgccacgaacatgtatttgagtacctattttgaaccattttacattctcatcagcaatagctccaatttcttcacatccttgccaacatatgttattttccactttttgggttatagccatcctcgtgggtgtgaagtggtaccctctcttggttgtgattcgcatttgcctaatgactaatgatgtggagcatcttttcatatgcttgttggcatcatttactttaaaaaaaaagtcttaacattaaatattttgaattttgtaacaattcaagttttcagaaaggttgcaagtatagcataaagaaaagtttcctggccgggcgcagtggctcacacctgtaatcctagcactttgagaggccaaggcaggcagatcacttgagctcaggagttcgagactagcctggacaacatggtgaaaccccatctctacaaaaaaaattagccgggtgtggtggcacacacttgtagtcccagctactcgggaggctgaggctacagtgagctgagatcacgtcattgcacaccagcctgaatgacagagcgagaccctgtctcaaaaaaagaaaagaaaaaaaaagtttcttgaaccacttgaatgggagatgtcaacctaactgcctgtcagccctgaatacttcttatttcctacacagaaagacatgatagagccatcaaagttaggaaactattattgatacgttaccatcatctaatcctctaacgctattcagatttcatcaaatgcaccagtaatgccctgcacggtagtaaattcagctgagaatcacacgccacatggagttcttatgcctctttaacccctcagcccttccttgactttgacgacccacagcactttccaagatagcggccgttattttgtagaacacccctcaattcgggcttcttttctgtctcctcataagatgcaggtgttatcctttgccaggaacatcacagaagacaaactgcattcttctcattgcatcctatccagtagcccaagatgtcaccttgtcccattaatgatgttcgttgtcatcacgtgattaaggtggtgtctgccaagtttcttcactgtagttactttttatttttgtaatgaataagaatttgtggaaagataccttgaaactgtctaaacttgttccttatcaaactttcaatatattcaattattggctgctattaggaggcactcagggttttctgttttattcagtaggctacaattcattactatcagtatttattttgatgtataaattgtcctggatttggccagtgggagccccttcaagctggttcctgtgtctttctcgaatgtctttatcatttttgattaatttctgactttcctaccattgcctattcaaggtgctagaaaaaggctcctgtttcaaattcctaccaaactgctgatttcctctttctctcaccctggccatgtgtctctgtcaagataaaaaaaagcactgcaagaggctgggcgtggtggctcactcctgtaatcccaacactttgggaggctgaggagggcggatcacctgaggtcaggagttcaagaccagcctggctaacatggtgaaaccccatctctactgaaaaaaatacaaaaatttgccaggcgtggtggcccatgcctgtagtcccagctacgcaggaggctgaggcaggagaatcacttcaacccaggaggcggagtttgcagtgagctgaaatagtgccactgcaatccagcctgggcggcagagcgagacttcatctcaaagaaaaaataaaaaataaaaagaagcactgcaaaagagataaaatgtagttacccacagggcagagattctctctctctctcttttttttttttttgaaacagggtttcactccgtcacccaggctggagtgaagtggtaccatcatggctcactgcagcctcaacttcctgggcttaagtgatcctcccacctcagccacctgagtagctgagactacaggtgtgtgccaccatgctggactaatttttattattttttactttttgtaggacagggtcttgccatgttgccctggatggtctggaactcctgggctcaagcagtcctcccactttgcctaccaatgtgctgggattatacatgtgggccattgcgtcctccctggaccgagattcttgaatatgtagtgcccagcaccagcaggaagtcagtgagtagatttgaccattggttggatgtatatctgtgacttagggtccataaagatcttttgaagaactgggcactaatcccaacttcgcattagacaatgttgccaagcaggtgggttgttttttagcatatttgagaagggggaaagagcccactaactttctgggcaaatttgggcaaattaccaaccattgtgggtctcagtttcgactgttaacagggttgcctgagcattgccagtatatatgatgaagtattggccaggtgtggtggctcttgcctgtaatcccagtctttgggaggtcgaggcgggaggatcgcttgagtccaggagttcaagaacagccgaggcaacatagtacgacctcatctctacaaaaaataaataaaattggccaggtatggtggcacatgcttgtagtcccagatactcaggaggctgaggcatgagaattgcttgagcctgggaggttgaggttacaatgagctgagattgtgccactgcactccagcctgggcgacagagtgagactttgtctcacaaaaaaaaaaaaaaaaaaaaaaaaaagaggagaaagaaaaagaaaacgaagtacttacaaatataagggttggctcctcattggttatcagatggaagacagcccctctttagcccaggacaacgtcgaagattgactagacattcagactcacaagacgatgacagaacgtgctccgatctattcagaaggatggggacagaggccctggcctgccagcagaacaatgccaggctgccttgtgtgaggagtcctggagaatttctcacagcagagtatgtaacatccaggagttatcttagccccatgtgatggtcatggtgcaaacagacggggccttcacagggaggtgcagggtctgcgtgggaagatgcgcaccacagggcagtatctcggggacgtgactttcacaagcgtcactgtcttggttcacctgggctgctataacaaaataccataaattgggtaggttttttggagacggggtctcactgtcacccaggctggagtgcagtggtacgatcatgactcattgcagccttgacatcccaggctcaagtgatcctcctgccccagcctcccaagtatctggaactacaggtgcacgccactacgcctggctaagttttgtatttttagtaaagatggggtttcgctatgttacccaggctggtcttgaacacctgggctcaagtgatccacccgccttggcctcccaaagtgctgggatcacaggcatgagccatcatgcccgtcctgggtagcttttaaactacaaaatttattctcacagttccctgagcttagaaattcaggctcagggtgccagcatggtcaggttgtgacaagggcccttttctgggcggcagactgttcacctctcactgtgtcctcacatgagggaaggggcaaacaggctcctcaggcttcttttataagggcacaagtccaattcatgagggctctgcccccatgatctaatcacctcctaaagccccagtactactgcactggggattagatttcaacacagaattttttttggaggggtgggggggtcacaaacattcagaccatagcagtcaccaaaatgctgagaagttcaaagcatggcgtctacatcagatatttaaattccattcctagctactcccagtccatatgtaattcaccagtcaggggccatttttaccataagcaatgttgcctggcaatgtagttgacatatagcatcttaactggtttacagggtgaggcaggcagaataatggcttcccaaagttatctgtgtcctactccccagaacctgtgaacatgataatgggggttttaggttgcagatgcaattaactaaggttgctaactagctgaccttaagacaggcaggttatcatggattatcctagtggaccctatgcaatcacaaggggccttgtaagtgaaagagtgaggcaggagagtcggtgtcagtcagagagagagatgaagatgctacactgctggctttgaaggtggaagggggccacaagtgaagggaagtgtccagcctctagaagctggaaaaggcaagaaggattttctcctggtgtttcctgaagaaacacagctctgccaacagcttggttttaccctactgagattcattttggacttctgacctctagaactgtaatataataaactggtgttaagtcactaagcatgtggtaacttgctacggcagcaatacagggtaacagagctaggtagttgccaaggttgggttctcatgcagcagaggaagagggtgtgtgaacctttcaagcagtcctgacatataaggctggcaatcttcacctcctgggttcaagtgatcctcccacctcagcctcctgagtagctgggaccacaggtgtgagtcaccacgactggctaatttttgtatttattgtagagacgggcttcatcatattacccaggctggtgtcaaaatcctgagctcaagtgatctgcctgcctcagccttccaaagtgttggaattacaggcgtgagccgctgcgcctggcctagattctccatttcttctgtgtgatctttggttgtttgtgttttccatagaatttatccatttcatttcagctgctgaatttatggccataacattctttgtaatatcctttttatgtatgtaggtctgtagtgatgttccgtctttcatttctgatattggtcatttgtattttttttttcttggatggtctggctagagatttatttttatgactcttttcacaaaagcagcttttggtttcattgactcttttttctgtcctcaattttactgatttctgctttattattctatattatttcctttctctgcttcttttgaatttctctctctctctctttagtttattaaagcaaaagctgaggtcagtgattagagagaccttcctttttttctaaaataaacatttttgcctgacacagggatcagggttcaggcagatgggtgcctgtgcagacgtatggactgagctgctcctgccgtagccagcaaccctggggccctgcagctgaggctgcatgggggtggctgctgtctgcttgagtgtcaggcttatttggtgaccatgaagctgctgtacctggccttccacagctgcctcctactggccctgctcagcgcatggtgaactgctcctgaggatcatgcgtcacccacaggcgtgcacgctgtcagtgctacctctttcctgtgggataaactcagcagctgaatctggatgtggcagtgggctgggagcagcctcatcctgctcaactacctggaattgggagtgaggtgggataaggtcactgagcccatgcagggacagaggaacctctcgatgtgctttagttctggagactgctttgctgcccacaatttcagtggcagtcatggattggaaggagtgagctccaggagctctgccgccattctccaggagctagattcctggcccgcacctctgtggaccaggagaacgagagaatgcatagatcgaagaggggaggctgagcacaattgaagtgtggggatatagtctcctctgtgtgaccattatcatggattatcctggtggaaccaattaccatggattatcacaagggaccttgtaagtgaaagggcgagcagaagagtcagtgtcagagtcagagagagatctgaggacgctacactgctggctttgaaggtggaagggggccacaagcgaaggggagtgtgcagcctctagaagctggataaggcaagaaaaaggattctctgtcatgctgttcaatgctgggatgaccatctagtgcaactgaagtgtggggatacgatctcctctatgtgactgtcatctccctctgctccctcatgggcaccatcgtggtgccttcaagaaggccttttacagaaggaagctgctgctccacgtcatagctctggcgattggaatcctctagtccaatgtgctctcctagctcattcctggggcttttgatttcaaccctctggaagatgattatgtgtccaagtctgcagtggtgtctgggggcttttatttttatttttcagagatcttgaagatgtttctcaaacaggaaaatgaacatcacatagacatagccattatgcctctgagaggcttccttccaagaagcaccaggaggaggggggtgatggagaagctgcagaatggggacctggaccacatgagccctcagcactgccacagtgaactggatggcaagcagtccatgatggatgggaaggtcgtggtgggctcactctctgtgctggttctgcaggctccccagagtgcctgctggagctgaaaggtgtccactactttatcagcactctggcctgggtgatcaccctaagcaacagcctccacaatgtcctcagcagcctggccactggcgcctctttcaccgtctgtgtggtccaaggcctcggcacctggtggccgtcttccatgaggagttcccacatgactttgtcatcctgcttagcgctaggaggaccattcagcactgtcttcttcaacccccttccgcctgctgctatgtgggtctggcctttggcatcctggccagcagccacttctctgccaactgaatttttgtgctggttggaggaatgttcttgaatattgctgtggttgatatgttccctgagacgaatgaggtctgccaagaggatgggaggaagggcagcatctccatcccctttgtcattcagaacctgggtctgttggccagattcaccgtcatgctggtcctcgtgatatattcaggacagatccagattgggtagggccctgccaggagcctgtgggatgggaagtcaggccctgggctgcccgatccctggcctgaggactcgccatccacaaagcaccgtggaagaggttgttccatgaaaaacttacacagattgtattcccgccttcagatgtcagcggtgtttacaatgctctgtcctaggaagaaacgtccctagtaaccagtctccaggtagtacctctcaccctctcctcacctccttttctctctgtgactctggaacctgaatgcagcttgcaagacaagcctttttctctgattaccctcgcctctttcccttggaaccagtgctgaaagatgtgtgtgtgtgtgtgtgcgcgcgtgttttgagatggagatttgctctgtcacccaggccggagtgcagtggcacgatgtcagctcactgaaacctccaccttccaggttcaagcgattctcctgcctcagcctccccagtagcagggattacaggcacccacaaacacacctggctaatttttttttttttttttttttcagtagagatgggttttcgccatgctggccaggctggtctcgaactcctgacctcaggtgatccatctgtctcagcctcccaaagtgctgccattacaggcgtgagccactgtgccctgcccagtgccgaaagattttgaatcctttacctgacaatgcaaaaatacagccagtggttttaacttggttagaaatatcaagaggtgaatccatagtttggggcccatgacattggctgggcatcctggacctccggctggccagttttgaaacaggttcacctcttcttacagagaagatgcaggaatccctcttattttttcaaagtctgcttagttgcctattacttctctcagagagaattctaagtgagaacagatgacagggtgagaggggaggcagggatcatccggagtgggagagaaagtgggacggatgctctgtgtcttgtcattttgctcatctgctcctagcagaatgctgggtattgatttgggggcagcacctggtatttcctggctgtccaggtgagctaatgtggaggtaatgtagcttcctggacctcctctttcaggtcaacactgacagaatggaaggtcagagagtctacaaggaaacaatgttttgctgtgattcccacttcccttccccactcctatcttctaagagacttgcaggctgggtgcggtggctcacgcctgtaatcccagcactttgggaggctgaggtgggtggatcacctgaggccaggagttcaagaccagcctgaccaacatagtgaaaccccatctctactaaaaatacaaaaactagccaggtgtgttggtgtgcacctgtagttccagctatttgggaggctgaggcatgagaattgcttgaatctgtgaggcggaggttgcagtgagctgagattgtgccaccgcactccaccctgggcgacagagtgagactctgcctctatctaaaaaaaaaaaaaaaaaaagaaagaaaagaaaagacaagacaagacttgggagctgcctccctaaaagcacattctgagcatatttcagacatctctgttagaaggcagactgcacaaactatcctcccctagtggagatatctgcacagtggcaagctgactggtagaattggaatgcagtttatgctctgcttaaacaagggtaatcagaaatggaatcagtgcaagcaaaatttaggatttgctacttccataaataaaagcatgaataacaggggtctctgaaatgtaaggtcacaaacttagtttggggcactgcagatgtttgcagaatggcagcccagtgattatgctacagatgggctttcaatcacctgtgtaggttaccgcttcctccctcacacacacacaaaaagtggaatccttcgttgaactgaatatgaatatgaattgctctgattctgcccagaaaatggacggatatacttgtctgtaaaaccgtgggccagcctcaggcacgctggatcccttgcctcagaactctggcttcaaggaaagctaatctgcagggctcactgtgtgaatcgatttattactatcacatggataacatgagtttctttagccaatttgggaagccagactctccagaagcctttctcagtggtgcctgcagttgcagcccaggggctgtgttcacaaactgattcgtgtgcatgattcacaagagtactgcttcattgccattgcctaaatttttaatctttttgtttttttttttttgagacagagtctcactctgtcaccgaggctggagtgcagtggcgtgatctcggctcactgcaacctctgtctcctgggttcaagcaattctcctgcctcagcctcctgagtagctgggattacaggcatgtgccaccccacctggctaatttttgtatttttagtagagacggggtttcaccatgttggccgggctggtctcgaactcctgagtccaagtgatcctcccaccttggcttcccaaagtgttgggattataggcgtgagccactgcacgccgccagtgagtttttcatcttcttagacagaaaactgtccactcttagtcattaaaggcagcatcagctgggtgtggtgagttcacgcctgtaatcccagcactttgggaggctgaggtgggaggatcacttgggctgaggagttcaagaccaccctcggcaacattgcaaacgctgtctctaaaaaaaaaaaaaaaaaaaaaaaatttatatatatatatatatacacacacatatatatacacacacacatatatatatatacacacacacatatatatatacacaaaaattaattagctgggtgtggtggtgtgggcctgtagtcccaaatacttgcagggctgaggtgggaggatcacttgatcctgggaggtggaggctgcagtgagccaagattgcgccactgcactccggcctgggtgacagagcaagactgtctcagggaaaaaaacaaaaaagcatcagttttgttttcccttcctgggagacatctctcaaaccagggatattcttgaaaagagcatgagcaaggaaactgctggtgatattacaagtttctctccttatcttgcctgttgacttcaatagatttgagaataggctgaagagggaggaaaacttcagtgattgagattctagatgaaatatcaggactgactcctgataggattatggtccaggttaaccaaaaaccaattccttgaatgttgaaatctaactttttatattatctttattattgttataaaaacagttcttcatcttttctgttttatttttctaaaactgctttcaggagctaccagaaaataacactcaaagtttatgactctggaagattttgctttccctaactcacatcgatgtattaaatgtataattttagcattccctatagatcttcttataccttaaaaataatagcctttgttttggagaagaaagtactaagttagagttagcaggtttcttgtttaggagaggagctcaaaaatataacctttaacaaattgaaaaataaaatatgaaataatagggtgctttctcttttgtgcacagctatattaagaaatttcctttcatagacagctacctcaaagggaaatccttttaaaactttcgttggaggttgggcgtggtggctcacgcctgtaatcccagcgctttgggaggctgaggtgggtggatcacctgaggtcgggagttcgagaccagcctgaccaacatggagaaaccctgtctctattaaaaatataaaaaattaggcgggcatgttggtgcacgtctgtaatcccagctacgtgggtggctgaggcagaagaattgcttgaaccggggaggtggaggttgcggtgagccgagatcacaccattgcactccagcctgggcgacaagagtgaaactctatttcaaaaaacaaaacaaaacaacacaaaactctttgggtgcagaggtcagtcctagtcggaacttagtggggctggagacagtcatattatctcctgactgtaagttgccgttggcaacagctttgcctggtgagttggacttctgggtgttgaatgtgcagtttgtttgtttgtttgtttgtttgtttttgagacggagtctcgctctattgcccagactggagtgcagtggcgtgatctcggctcactgcaagctccgcctcccgcgttcatgccattctcctgcctcagcctcccatgtagctgggactacaggtgcccgccaccacgcccagctaagtttttatatttttagtagagacagggtttcaccgtgttagccaggaaggtctagatctcctgacctcgtgatccacctgcctcggcctctcaaagtgctgggattacaggcgtgagccactgcgcccggccaaatgtgctgttttaagcatttgtacatctagaagtctaaggaatagccagttgttctaaagacttttcacccctggcattagtagcttcaacctctttctggatggaccagcccctgttaatgttaccaaggaaagtacatgtcacatgcaggaacagtaagccagcaccaggtgtctgctccttctcacctagtcactggcaggcaggctgcccctgtccttgctcctacaggtattttgtgtctaatgtcaattttgggggctattcctcattggtccgtcaccttgggtttaaaaaaaaggaggctctgtttgggttgcctaagatctggtcttagtaagccctcttctgacgagatggtaatatgctggagattagccaaaaaaaaaaaaaaagtctaatttttttttaatttttcttttttctttcctttttttctttttctttttcttttcttttcttttttttttttgagacagagtcttgctctgtcacccaggctggagtgcagtggctcaatcttggctcactgcagcctctgcctcctgggtttaagcgatcctcccacctcagcctcctgagtagctgggactacaggtgtgcgccaccatgcctggctaattatttttgtatttctagtagagatggggtttcaccattttggccaggctggtctcaaactcctgaactcaagtgatctgcccacctcagtctcccagcatactgggattacaggtgtgagccactgcacctggcaaaaaaaagttgtccgatatttgtgtgagaggattttattgttcatatttccctttacagttctgcaattccactgcagtattttaccctttttttttttggagacagagtcttgctcagtcacccaggctggagtgcagtggcatgatcacggctcactgcagctttgacctcctgggcttaagtgagcctcctgcctcagcctcctgaatagctgggactacaggagtgcaccaccatgtctggctaatttttgtatttttagtagagatggggttttgccatgttgctcaggttggtctcgaactccaaggttcaagccatcctcccacctcggcctcccagagtgctgggattacaggcatgagccaccgcacctggcctccagcacattgttttaaaaaataactcagctcttatgaaaagaaattagaaaataaaattaacttatgtggactgtaaatgatttgtaagattctataaataaagctatattctataaaaatgaaacgaaataaaatcagcatttaatggtatgaatttccctttaatcactgagtcccacacatttttatatcaattcaaaatattttctaatttctcttttgatttcctttttgaaccatgggctatttagaagtgtgttgttagattaggtgaggttagattctgatctcagcttaatttttagtctttgcaactccaagagacgtgagtagtggtatgaatcctaattctgttctcaaagcttttgctatgttactttggttctgtcctaagcatgtgtagctaaggggtgaggctggaacttttgtggttcataaaaagagttagatgaggctgggcgcggtagctcacacctgtaatcccagcattttgggaggctgagttgggcagatcacttgaggccaggagtttgagaccagctgggccaacatggtgaaaccccatctctactaaaaatacaaaaattcggccaggcacggtggctcacctgaggtcaggtggctcacccagcactttgggaggccgaggcgggtggatcacctgaggtcagcagttcgatcacctgaggtcaggagttcgagaccagcctggccaacatggtgaaaccccgtctctactaaaaatacaaaaattagtcaggtgtggtggtggaccccagctactcaggaggctgaggcagaagaatcgcttgaacctgctgggaggtggaggttgcagtgagccgagattgcaccattgcactctagcctggtgacagagtaagactccatctcaaaaaaaaaaaaaaaaaatagccaggcgtgatggtgcatgcttgtaatcccagctactcgggaggctgaggcaggagaatcgcttgaacccgggaagcagaggttgcagtgagctgagatcgcgccactgcactccaccctgggcaacagagcgagcctctgtttcaagaaaaaaataaaaaagaatgagatgatccacttctcacactctctcctctccagggtttctgccacaccctccagttcaaaagggcaccttttcctgtttccctgaccagaaagacagggtttatcttggagatttagcctgcatgcagccaccactgtgcaattctgaactggggcccgttcttggggcaaagctgtgagagaaaggagaaaaagaaaaaaaaggatcacagggttccctttccccagttcctctcgccagccatgtggggtttccatcagaacattcgctacctgcacggccaccgctgcagccctgctcttgggcccactcaggtcaaagccacaagaataaggagaaaacaaatgtaaaggacactcccatccacacaggtgacttcgtggcttctgcctgtcctccccaatccacatgctcttatgtgattcgtgagtcctcagggagttgctttttatatttttccagcgtttttgctgcagtctgcaggagagacgggctgtagcgggcttgctccatcctgggctctccatatgccactccctctgctgagaacgctcttcctttcttgtctggtgagcacctattccactcccataccttgcatcagctgtcctgacctccagggaatctttcctgacctccagaggatctttcctgaccactttcaccttttaaattcagagcggggggtgcctccgccacagcagcccccctcatcatgctgtctccccagcaaccagcagctggggtaggagaaagacctcctctttcatgcacatctctgtattcccagcttgcaaaaagctgagggaagaatgattatttctattatctatctgattctctactaaagagacaaaatggacatctaaaaatcacaataacacaaaaactccacaatgtttaaatgctgtgagccgaagacggagggtcctccgagcctttgcctggccagagtacaggtgaaaagcacatgcctgaagagcgtggctctagcagtcccttcaaagatcatctagtacttcagtctgtgtggccaattccttttttttttttttttgagacggagtctcgctgtatcacccaggctggagtgcagtggcgtgatcttggctcactgcaacctctgcctcctgggtgcaagcaattctcctgcctcagccccccgagtagctgggattacagccacgcaccaccacgcccggctaatttttgtatttttttttttttagtagagatgggggtttcaccatggtgcccaggctggtctcaaactcctgacctcaagtgacccacccgcctcaacctcccaaagtgttgagattgcaagtgtgagcccccgtgcccggctgccaattccattttgacatgatattgtttcaatagaaaggctatttttacaaagtagaaagtgacagttagaggaaaatgataattttgagttttccatttcattttttaactgaagaaaagacaaaagctgtcatattccagctcctagcattattcaagaagaatgaattttctataaccattcctcgggcaaaccattcatttttacattcctgaagaattaactttgttaaaaaacaggatgtctttgttccagagtatcaaggttttgcttaacattgtgtgcaattttgcttctcatttcatttgcttcctatgagatttttttagcgctaagacagatcaaagaaggtttccttgttgcctttggctccactaccatttcctctcccagctcctcagctaactggttatttgcttggccagtagtgctatttgcaaacaggctcctgaacactgggagaagatggttgctggtaaattgcagcttgtgggaatgtctgcaacacacagctgactttctggaacgtggggaaccgctgacctcaaacgtaggttcaaggaggaaccacagcctgctgaggacccacactgaggtgctggtggatgcgggcagctgccaagctgatgaggaagggtttccaagaagcaggtcagggccccagcctggcaaaggggctctggggctctgggggagggaacgaagattgatgtcttttgcaggccgaccctgtgacccacacaaagccacaagaatgatatccctttcccttgctttctcctcttgccctgggacagtacttttcttccccattttcctagccttcttctgcaaacttcccggcatttaaaaaaaataaactttattttttagagcagttttaggttcatagcaaaggtgagcacaaagtacagagttcccacataactcctgtccccaaataggcgcagcctcccccatgaacatcctgcaccagagtggtccatttgtgaccatcaatgacccaacactgacacatcaatatcacctaaagtccatagtttacaatagggctcactcttggcactgcacattctatgggctttgacagatgtctaatgacaggtgctcactattatggtgtcacacagaggagtttcctgctccacctattcaaccctccccaacgccacattcagagcaggaggtgcctccaccacagcaaccactgatctttatactgattccataattctgccttttccaggatgtcatatagtgggaatcacagtatgtagccttttcagactgatttctttcactcagcaatacgtatgtaagtctcctctatgttgtgtcatgacttgatagctcatttcttttttagtactgaatactattccattttctggatgtttcacagcttatttatccattcacctactgaagaacatcttggttgcttccgagtttgggcaattatgaataaagctgctataaacatctgtgtgcaggttttcgtgtgaacataagttttcaacccaggaaaattccaaggagtgcaattgctatagcatatgggaagaggaggtgtcgttttgtaaggaactgccaaactgtcttccaaagtggctgttgcattttgcattcccaacagcaatgaacaagagtgtctgcttctgcagatcctggcccgctttgtgtattctcagggttgtggattttggccattctaaatggtgtgtagtggtttctcctccttttcatttgcatttccctaatgacatatgatgttgagcttctcttcaaatgccatctttgtatctttggtaagatgccttttcaaaacttttgctcatctttaataggattttgttttgttttgttttctattgagttttaagagttcttttgtattctgagtgacagcatttatcagatgtcttgcaaatgtcttctcccaatctgtgacttgtctgctcattctcttgactttcccaagcttttcaaagctcatagggagggcctgggactagagggaggctagtgagggacctagaacacagaatttaaagaggtgatctatctcagggccttgcaagtgcgatgagacacggccgagtgcctctttaaattctcacctaattctggtcctgctgatgtggtcagacctcagctgcactaatgtccagccccaccgtctactgagcaaactcgtcactctctgataggaccttttccgtgaccattgctgccaagacagcagcttcataaagaacaccaggccgggcacggtggctgatgcttgtgatcccagcactttgggaggccaaggcagtcggatcacctgaggtcaggagttagggaccagcctggccaacatggtgaaaccctgtctctactaaaaatacaaaaattagctgggcgtggtggcacatgcctgtaatcccagctacttgggaggctgaggcaggagaatggcttgaacccaggaggtggagtttgcagtgaactgagattgcatcactgcactccagcctgggtgacagagtgagactctatctcaaaaaaaaaaaaaaaaaaaaaaaaaaaaaaaaaaaaaaaaagaacttagaacccaaattagagactgtctttgggactgggagactttctcatgacaaacaagaggaagagaaatgcaccatcgctactcacagacctgagggaggctctgtcacttggcagcatgactttctgaaagctgtcttatctctcctagcctggggttttcacacctgtggaataggtaaaatgcacttaccccatgacatagttttttgtttgtttgtttgtttttgtttttttgagacagagtctcgctctgtctcccaggctggagtgcagtggcccaatctcagctcacgacaacctccgccttctgggttcaagcaattctcctgcctcagcctcccgagtagctgggactacaggtgtccgccaccatgcccagctaatttttgtatttttagtagagatggggtttcaccatattggccaggctggtctcaaactcctgaccttgtaatctgcccgcctcggcttcccaaagtgctgggattacaggcatgagccaccgcacctggccgacatagttttagatgaaatgagatcatgtgagtgaagggtttggaaaactgtctggtacggcacagggggctgtgaggaagtggcagctctgatcaccactgatgcatgcaggaaccagctgcggcagtcaatctgtgcttcagacttgtgctgcagaccatttacaatggcctctccccaggacactgttggaaactggaaggcttccgggtatgttaacttcatcagagaggaagactggagtatactgaactctttgaaaggaaaatcaggatccttagtttcaaccatgagactggatagtattttgtgatatcaaccaatacttccccattcaaggaagggatgggtgtgatgggttaaaatacagatatggggccgggcgtggtggctcatgcctataatctcagcactttgggaggccgaggtgggaggatcacctgaggtcaggagttcgataccagcccgacgaacatgaagaaaccccgtctctactacaaatacaaaattagctgggcgtggtggcacacacctgtaatcccagctactcaggaggctgaggcaggagaatggcttgaacccgggaggtggaggttgcagtgggctgagattgtgccatcgcactccagcctgggcaacaagagcgaaactctgtctcaacaacaacaacaaagacaacaacaacaacaacaacaaaaaaccagacatggcccaagagtctttctggcttttgtttccaaaagcctaaaccccagaggtgagaaagaattcagagtatcggaggaaaatgtcttggccagaagcaggaggaagaagagcattgcctgcaggaccggagagtgaccctctctgcaagctggggtggttgggggccacaaagccttgttaggagacgggggggggttacaagaccctagaacaaaatggccattgggtgccctgaagcggaggaggtcatgggcagtcttgtggagagttttgtgtccccaggcaggacccaagaccaccaacagcaaccagcctaaagggtccccacccagatgatggtgtcctacgggtcacccagtggacagatacctggtcctgtgtaagttctggggaaacactgaggcaacccaagcaggccaaacaggcagaatgcatgcttcgatttgcgttttaaaacatttagaaaagtcacttttccccgcatatctgaatatggggattgagactcgcatcagccctattcactttgatccgcaggtgctaggtggtggccctttttaaagacagcttccctgcaggaagcccagcctcctttctctgtatggcttctctcagggtttgccattcccttcacttttgcatttgtagagtcttcagcttcctttggttctgagcaggacccaggagatggacatgcatttcctctctgacaaaactggcacttgttctccttggaagcgataaagtcaaacatttgcttgaatttttttttttttttttttgcttttttgtttgtttgtttttagagatggggtctcactctgttgcctaggttggagtgcaatggtgcaatcacagctcattacagcctcaaactcttgggctcaagagatcctcccacttcagcctcctgggtagctgagaccctaggcacgtgccaccatgccccgccaattaaaaaaaaaatgaagacaggggcttgctttgttgcccaggctggtcttaaataactggcttcaagccatcctcccaccttggcctcccaaagtgctgggattacaggtgtgagtcaccataccaagttgggataactcttctgaaatgtcaaatgcaattacaagaagcaaaaaaattggtcccaacttctcccatatggtatgaaaaattaaagaatttcaatgcagttgcctttactctcggggacctaggcctcttccactcgcatgcttttgcttccactattttatctactttacccctccttgactcagcacccaacacttcttgtgaaaagccatctctgccctccttcaagggttcattctgaggctaccagcctctcaaatttttctttcttttttctttctttcttttttttttttttaagattgagtcttgctctgttgcccaggctgaagtgcagtggcatgatctcggctcactgcaagctccacctcctgggttcaagctattcttctgcttcagcgtcccgagtagctgggactagcatgccaccatgcccagctaagttttgtatttttagtaaagatggggttttaccatgttggctaggctggtctcgaactcctgacctcagataatctgcccgcctcagcctcccaaagtgctgggattacaggcatgagccaccatgcctggctcaaagctttcttgagctgggcagccaccttggtccctggacctgagcactccccttcatttctatgacacttctgggtttttactgtcttcatcacattgttcccctctacttatcctttctcatgttggtggacaatgaattatttccaatattttcttttgtacaatgatgttatgagcatgtctcttgcacgataatttttccagggtagatactacaataggattagagttggtgagtagagatgccacacatcttcacttttacacttccctgtctgttaaaatagaatgagtaacctccattccccataacttcacatacactaaacgcacactcacaaaagaggctggtcatctttcttcaagacattcaagaattctcttgtgggactatttcagaaaggtccccacattgtcagcaccttaaagctgccagatacacatcttcaaatgccgtaagtacttgaatgtttgctgctgaaaacagcagcctgtgactcaactacttgaataatcaagaccaacagcctgatgatgccacgctctcatcacttatcagatgccgtcatcaaggctgagcagcaacagccgggtgttttgtttgtcccgggaattctgacgaaagtacacggtttgcaaagtgccagccagcactgcctgagacagcaattcaaggcctctggagcagggtcgcctgtcatacgcaagtcctgtctgatggctcaagctgccccaggaatgaccagaaagtcaccgtgggagtgtggacgcagctcagaatgacctagacgcatggcctgtagacttgagggacacgggctctggaagaggaactctgaaatactactgtagctggtgttagaaaataatcaattgggtggccagaggctgagatggctgttttgcctaggattctgacctaagcaaactaaacccaactcaatgtcaacagtaaaatgaaacgtgagcctaaccaatcaccagctaatttctaatgagagactctcctttttttttttttgagacagagtcttgctctgtcaccccggctggagtgccgtggcacgatctcggctcactgcaagctctgcctcccaggttcaagcgattctcctgcctcagcctcctaagtagctggaattacaggcacgcaccaccatacccagctaatttttgtatttttaatagagatggggtttcaccaggttggccaggctggtctccagctcctgacctcaggtgatccgccctcctcggcctcccaaagtgctgggattacaggtgtgagccactgtgcccagctgagactctccactttaactgatcaagtattttttctttgtcttgcttccaagaacaccttataaatgtttacccctcacgccccctcagtggagccctgaacctcttgcagtttggtgctgtccaattaatgaatcaccctctgctcggataaactctctaaaattgtaatgtgcctaggttgatctttccacactggttacatgctgctctatcagctgagaacctctgggaagcaccgtcctggagcatgcagcactgagggctggtgggcattgatgctctgagcggaggctcggtgcctggaccctaaagtggcttctgcattaacactgtttgcatgcccagcgtagcttacttttttcttttctttctttctttttttttttttcagacagagtcttgctctgttgctcaggctagagtgcagtggtgctatcttggctcagtgcaacctcctcctgggttcaagcgattctcctgcctcagcctcccaagtagctgggattacaggtgtatgccaccacgcccagccaatttttgtatttttagtagagatggggtttcaccatgttggccaggctggtcttgaactcctgacctcaggtgatccacctgccttggcctcccaaagtgccgggattacaggcatgagccaccgcgcctggccagttttttctaattcctatgagtggcaatacgtggatgagttctcagttaaccaaaagatagcaagaatacttccttctgtgcacacctcaaacagcagagtttaagtgaagcctgggagggcctgggaggtcaccagcagagggctgtgtgcggaggcttgctgcttcccagctgaacagcccgtcatgcagggcaaggcttagttgacatgtttttccttctttctttttttaagagacaggttcttgctctgtcaaccaggctggggtgcagcggcaccatcatggctccctgcagccttaaactcctcctgggctcaagtcatcctcctgcctccttcctgaggagctgggattacaggcacacaccaccatgcccagctagttattttattttttgtagagacagggtctcactagattgcttaggctggtctccaactcctgggctcaagcgatcttcccaccctggcctcccaaagtgctgggattacaggcatgagccactgcacccggccaacatgtttctcatctgtgtgcaaagactgaatacctaggctgcaaaatgagctcccagaaatgaattagaaaattctgccttacaagtacaaacagagaagtggttctggagatgtggtttaaccaactggaaaaagtatttttcagacaggaggagtggatgaggagccaggagacttgcttttaatcctatttctatttttaaaaattatttgtatgactttgaacaaggttttttctctttgtgttttagtcttcccttttgtaactgtctgtcgtcttcctgccccaaaacgattagaattaagtaaaatgcctcagctgggaacaaaaccaagatgacgacttggcacattcctagaatattagacattgtcatcggcctttgttgagattaagtaacaacttaatggctcgattctgaaaaaacaaaagcaaaaagaaaaagaaaaaacgtagtcacgtagttttcattctagattagaagcatggatgaaaccgaaagactattcaaagaaaattgcttttaaaagaggaaggaagaactaatcttgaaggctgtcacccacggacactgctgatcatctgttccatacattcaaaggatctctctacggtggttattcagaccttgcagacaggctgatgtctgttgctcaagtacgccatgcatggaagagagtatattggcagcagtgaaaaaaaatataggactcatttaaaaagcctggaaataatctggatactttccaggaaaaacgatgtagagtctgacgcagttgttgttgttttaatgagtgacagcctgctgctggtccctgcgatatggttgttcatggagacttgtccctgagcagcagagctggtggtatgaatggcaggctggggatggagacaagcagggataagttccacttcttcccaggagccaaaaaagccacagatgacaagatctgccctctgtgccagcaccccttcacctgaaatgacagaacttctcatgtaccatatggcgggacagtgctgggaagcctccgagcaagacagtctgccagggaggctggctctggttatttctctttccactttattttaaaatttaaaaaatttttatttttgagacagggtctcattctgttgcccacgctggagtgcagtggtgcaatcatagctcactgcagccttgaactcctgggctcaagtgatcctcttgcctcagcctctcaagctgctgggactacaggtgcatgccactgtgcccagctaatttttaaaattttttgtagagacagaagttcactttgttgcccaggctggcctcaaacccttggcctcttgcaatcctcccacctcagcctcccaaagtgctgggattataggcataagccactgtgctcagcctatttctcctctcaaccaggagtcacctggtggtgggtgaagaagcagctggatgggagaagtccaaccaggataaggccataaaaagcaagaaaaatgtacacatggcccagctcatggacagtctttataagcaaatagggaaggataaaaagacgagaatccaaatgtgagaagcagaaaaataaagctctggtcctaggaaaggttcatggtgggaaatgggaggattcgaaatcagagagagctcagattggggtcctacaggatggcacagttagttccactggtcactaactagtccccactcctccagggagggtgagggatcagctagtctcaaaattaccctccacccctgcaccaggaagactcactctctgtaaagcttcccagtcaatgcccttgtgtcacgagtggttactgtctggggccagtggcacgggcagtaaaaagaatttgccaagacagtcataggtacagaaatgcagatttattagcaaaagcatggaaatatgttgcaagaaagcaataggccagttagcaagagaggagctgactggaggagacaaaggcttcctggggattttataggatggagcttgttctgtgtgctggagagggctaagtgcagtattgataatgtcaaggtggctgtgaactaacttgcatttttctatcaaccgagggtctggtgatatctgggtgcaggaagatcgtgagtcatttgcgcagatgggctatgtgtcctagactatgaagaaacgcagatttatagcttatctgtattttctttctgctttcccttgctcccaccagcctggctccttgttcctaattaggaccccacagtaaggctgccttcctttgctggctggacgcagtggctcacgcctgtaatcccagcactttgggaggctgaggcgggtggatcacctgaggttgggagtttgagatcagcctgaccaacatggagaaaccctgtttctactaaaaaatacaaaattagccaggcgtggtggtgcatgcctcctactcgggaggctgaggcagaagaatagcttgaacccaggaggcggaggttgcagtgagccaagatggtgccattgcactccagcctgcgcgacaagagcaaaactctgtctcaaaaaacaaaaaacaaaacaaaaaaaagaaatacttcctttgctgaagtcagcagctgatagaggaaggcaatacaaagccgggtatagacagtgaataaatttagaaaatgtaccagaacatggcattgttaatgaaccatggagcaccagaaatggaaggattttgcaaaccatggttccaatggttttaaagcgcaaagtttaaacatttataaattaggtcccttctaaagtcaatcagacaaacgcagtctcttacagcctcttatggtttggatatttggatatccaaatctcatattaaaatgtgattcctttgggaggctgagacgggtggatcacctgaggtcagcagttcgagaccagcctgaccaacatggagaaaccctgtctctactaaaaatacaaaatgattcaggtgtggtggtatgcgcctgtaatcccagctacttgggaggctgaggcaggagaatcacttaagcccaggaagtggaggttgcagtgagctgagatcgcaccactggactccagcctgggcaacaagagcaaaactccatctcggcggggaaaaatgtgattcctgatgtatggaggtggggcctggtgggaggcgtttgagtcatgggggtggagccctcctgaggcctccccagaagcagatgctggtgccatgcttgtacaacctgcagaactgtcggctaaataaacctcttttctttatcaatcactgagcctcaagtatttctttatagcaacacaaaaccaactaatacatggctgtattttcagtatctgtcgccacagaagatacaacacgacaaagctgtgattaattcagtaacatacttaaattcatctttattaatcccaaaggcatctatgcatacttgcaaattaatcagcaggatacaaacacatggcagtcgcaattgctctacacaggtttcctgggttgtgcacctgtattcagagaccccttgcagtggctctgaaggcccaccttccaccttgaggaagctgaagggcagaagactgaaggtaacttaacctccttaaccaaccagttagtgtttgagaacctggtattgctgcactgccaggggacacccaggtaatggccaggaaccctcctcttgctagacaggtaagcccagactagtgtagggaggaactggctctctctctgtagagggagaatatcctgagagacagggctgggctgttttcaccgtgcttcctcatacctgcccctcctctgaccagccagagttatccgcactgcctcaaggagaatgaggacgattacacagaagtgcaaagaggaattttgctttttacttccaaagcgggttcagaaagccttcttcaggaacaagttttagacgctaaagcctttgatttatttgaggaaggctctttgggggtctcagaaaaggggaaccccaaaggcaccaggtcctgcggtgaggcctggggcaaggtctaggggagccccgtgtagaggagagcagctggcactgagcagcaggcctgcattccctcatctttgccacatggggagcagtgcctgcagcaagccacggccacgcagaggcacggtgcccacgctgagacctcccatcagagacctcccatcagagacctgcgtatctccatgggtcctccagcagggcaattgcctgtgccctgagatgttggtgagcctcaatcacattcctccatacaacaatctcatgttaagaccagagatccgatgaacccccaaagcagggtgggatccccaatactgacaggcgatggcatgcggatgccccagtgttgtacttctgtacctgggagggacacatcggaactggattctgggaccctatttccttgtaagtgcattctaggtctttccctgctaccccagctgctacctcttacccctagggcaagaggataccctaggaacagtgtggagttcgagtggaagccctgggtgccgtccttgctcctctaggcaccttgtcctgatggtgattctcctttgaaccacagtctcctccttcaagaatggggataaagatccctgcctccccactgcactccagcctgggcgacagagccagactccgtctcaaaaaaaaaaaaaaaaatccctgcctcctggcatttctgtaaagatcaagtggacagggtacatgaatgcttttagcaaactgaaaaatgctaatcaaatgctagtgattgctcctttgaaaatccaagcacagcctgcaaaatacttggaatataaattgagcagacatatcgggagtagtttcaggttatgcttacgtgtcctttatttaaaaaaacaatgcttaaaacaccacctaaaaattcctctgaccacctatttcagtcaaacgctggaagatgggggatgctttatattaaagaattagaatgaggctgggcgcggtggctcacacctgtaatcccagcactttcggaggccaaggtggggggatcacttgaggccaggagttcaagaccagcctgggcaacatggcgaaaccccttctctacgaaaaatacaaaaattagctgggcgcggtggcgcgtgcctgcaataccagctactaggggaggctaaagcatgagaatcgcttgaacctgggaagtggaggttgcaatgagccgagattgcaccactgcactccagcctgggagacagagcaagaccttgtctcaaaaaaaaaaaaaaaaaaaaaattagaatgaggaaaacaatgatgaggtggaaacagatgtttgaacataggagaattttcgatgcataaggatgctgcgggcacttaaccagatgtctgcccttcactacctggccagggtggcacttttaaaccatctgataatggagagaggcggcacagtctgtatgggcacacagctcactctgtggctgaagccacatgtgggtgcactgggcccaaggagctgacctctgctcttgtggcactcccagtccggcacagacttgaggagaccaccgaaaaggagcccaggccaatggcctgcaaagccacttccctctacttgaccaagaagagcttcccggaccctggctcctgcctgcgcatctggccagcttcatcttccaatgctcctggtctccgataagccccagctgctggactgctgtttttaaaccccttccaggcgggaggaacagaagagaggtgagtggacaggtgcaggccctggagcctgaatctgctcctttctagctccggaaatgtgggtaattcccttcacctcctgctttcttcccttcaaaatagaggaatggttgtattggtttctattgtggctacaacacattaccatatatttatggcttaaaacaatgcagttttattattttacagttctggagttcaaaagtctgaaatgggtctcgatggactaaaatcaaggtgccaggagggctgtgggtggaagctctggggagagttcgtatttctgccttttccagtgtctacagccatctgcaatcctgagcttgtggctcctcctgcatttttttttttttttaacattttactttaagttctgggatacatgtgcagaacgtgcaggtgtgttacatagatatacgtgtgccatggtggtttgctgcacctatcaacccatcatctaggttttaagccttgcctgcattaggtatttgtcctaatgctctccctgcccttgcccctcaccccccaacagggctcggtgtgtgatgttcccctccctgtgtccatgtgttctcattgttcaactcccatttatgagtgagaacatgcgatgtttggttttctgttcctgtgttagtttgctgagaatgatggtttccagcttcatccatgtccctgcaaaggacatgaactcattcttttttatggctgcatagtaatccatggtgtatatgtgccacattttctttatccagtctatcattgatgggcatttgggttggttccaagtctttgctattgtaaatagtgctgcaataaacatacatgtgcatgtgtctttatagtagaattatttataatcctttgggtatatacccagtaacgggccctcctgcatttttaaagccagcccagcagcatcccccaccttctctctcagatgcgcctatcttcctcttatgagaacctttgtgacgacactgggcctgccaggtattccaggatcacctccccatctcaggatctttccgttaatcacatctgcaaaatcttttttgctgtgtaagattcacagattcacaagttccaaggattagagggtggccatctttggggaccatgattctacctaccacagtagtcatcaggaataagtagttcatacaacataagccactaagagcctgggctgcaggaagcacttaattaatgtgagccataatcattctcccttgctgaaacagagcccccagcctggaaggctttcgccttgcactggctgtgccccaatagttccatctggccaaatcatgagacctccttccagatgccttccctgtccttctgggccgggcttggtgtccttctgtgttgaggtgggagcttttcttaattccgtgttgtatgctttttttttctgagacagagtcttactctgtcgcccaggctggagtgcagtggcactatcttagctcactgcaacctctgcctcctgggttcaggcgattctcctgcctcacaaccagctaatttttgtattttcagtagagacggggtttcacccacgttggccaggctggtcttgaactcccaatctcaggtgatctgcccgccttggtctcccaaagtgctgggatatcaggcgtgagccaccgtgccccgctctgtgttgtgttataatcctctgtctccctcactggattgtaaatgcctcaggagcagggatggcctctgacttattttgcattcctacccctaggacatggcacacagcagctgtcaaatgtctcctggacggctcatgggtgaaggtaggtctgtgtcctttggggtgtccagaacctcagagctgccgttgctgctgtgggaggggagcagtgagggggtctctaggtggggatcttgtgctctgacagaggcagctcttcagggtggtagctggtttccccacagagaaggctgtctctcaccccaggcagaagaggacagatccatgcattcagcctggggaggagacctggtgttgcaggcacatcatgcttacggtggtcaaaccctcacagccccacgaggagcgggagaggctggcataggacacaagagcctggggatgcttaggcaggttggggggaatcagatatcaggaataaggacccacagaaatcatttggttcaatgcatctcaaatctggtggctgcaaaactcaaagactaattcccggaccctagcccagacccactatgtcagaatgtccaggggatgaggcccaagaagggatattttaaaaactgcccaaaatgtatgcagccaggtttgagaaccactgctgcatctaccttaggctttatacacagactgtgctacaagtaaatggttctcaaaacaggtgtgtaaaacagaagaaaggatacacacatcattcaacagactacagtgaacctgccagaccacgcatcaaggcgaatacataagacagtccttgccaagctgcgtccttgagcccgcctgaatcccggcagggtggagttgagggcggcctctctacttcatttagcccaccagaccttcggacctgagggtctctgatccagcctctcggggccaccaccccctgcagggctccaggaagagtcaaattgcccggtgggccagagctctccctcccttttgttgccgcttggcgcctggcaggtcagaggtcactgggcccagcagccccagtccctggatgggtggagcacccacaaaacagccaggctgtgaagaggcccactttggagtgagaaggggctgcttcttgcgtgtcattttgcaaaaagaatctctgtctcttcctctaccttgagttacactaccaaatactccttttggttaatgtagctttcttatatgctaggggtgagaggaggggaaagccaccttattctgtcaggaaggcacttgggcataaattaatctgtaggccaagtgcagtggctgatgcctgtaattatgcactttgggaggccgaagtgggaggatcacttgaggccaggagttccagaccagcctgggcaacatagtgagaacccatctctacaaaaagttttaaaagaatttagccgggcatggtggtgggcaactgtagccccagctacttaggagactgaagtggaaggctcacttgaactggggagctcaagattgcaatgaaataccatcacatcactgcacaccagcctgggcaacagagcaagaccctgcctctaaaactaaataaataatcggcggggcacagtggctcacgcccgtaatcccagcactttgggaggccgaggcaggcggatcacctgaggtcaggagttctagaccagcctggccaacatggtgaaaccctgtctctactaaaaatacaaaaaattagctggcgtggtggcgggcgcctgtaatcccagccgctagggaggctgaggcaggagaatggcttgaacctgggaggtgcaggttgcagtgagccgagatcgcgccactgcactccaacttgggtgacagagcaagactccacctaaaaatataaataaataaataatctgtgactccatcaacactttcacctgttggctccacgtgcatcagatgagctcatttgggaggtcaccttaacctcggatcaacatggcaggtcctcccacaagcagcctatttaaaatgtgagccacccccttccccggaattccctacctcccagccttgttttatttttctctcatgcacttactatatcttaaatgcttatttattcatgtacttgtttaaactacttttgattttctgacttcttatcattggtctgattcctccaccgtaacagaacttccatgagggcggggatttttcgcttcccccgcaactgcctgcgttttcgtagccctagagcttccaacgtacagtgcggaaaagcaacataacacactaagaaccgtgcggaaaaggagagaaaaccagaccgcaggggcatttcacagctaaccacagcggtccgaggcgaacgcagggtggaagaacccgagcgaggcccggcaggggcggggtgagccttggccccgctcccgtgcaggtgtcgcgggtaagctgccgcggttactgtgaagcagggccaaggccagccctccgcctcgaggccactggtgcttgggggtgggaaaagagtgaccgggggcaactgagcaaaacatagaacagaaactccctctcgaatagagacccacgcacggaaggatgatacactgtgattccccgacgtgggcctgcagcaagagacgggtgctaacagcgtccgagccaatccgtaagcatcagagggacaaagaaatcataaacaagaggcaggatgcaactgcttcaacgcagaaagaatgagtcatccaggaaggcgaggtggtggcgggttggctgtggttttgcagaggcgggcaggaggggcagggggccagggagagggcagggttgggagggtctcttttaagggaatcctatgcatgaaagtctgtgtaagaaagggtgtgcctcctacagaaggatatttgttttgtcctaaacttgccgtgtgttcttggaggcgcgggcctccctgctgtcatcacacctcggatcaccccaggcaatctcgcccctgtggcttcacctgggtccagccagacctctgctcagctctgcacgtacatgccccctcgatgtcacctcctgacttggcaagtcatacaccctctctctacttgcccagcttcattcacaaaaccaggtcacattacccctcgtccatccatgctcagtctggaaaccctgggatcccagacaccagcctctccctggccctctgtttccaatcagacggccaccccgactgacgctggggccggggcacccttgggcgttatccagtctccctgtcctccctctcctgccccacgcctccgaccttccccacatggcagtcacagccagacggccaaggtggggcctgctgcttcctgcttctgcctgacaatggccctggattccccattcttcacggtcagtctcaccttcacaccccggctctgagcaacctttctgctctctccactcctctttcatgaccctgggcccctgctggccgccctgcctggaaagccctttctcatttgtctggcttgaaaaacctgcctcagctcaccagggccagctcaagactccctctgttgtcacacgctttctgcactgctatcagaaagaactaacactctccctgtctgtgcactaatccagggtaggtgggctgttttcacacatgcaccccctctaggttctgactcctctggagtgcatgaccatatcttatttgtttccctgtcaccagtgcctaaactatctgatgcatatatttattgcaggtgcttatcacacatgcagtcaatgaacacctcacaaatgcaaggttcacatgcagtcttcgatgaacacatcgatcgcatccagcagtatgtctgtattggaaaagtccttccatagcacccagtaatgaaaaggaatgtggcggggagcagtactggacagtaaaactaaaaacaccaggaagatcacagtgagatcagcagagccctagaatggcaaatccatgacaaagaaaatttctgatgaataaaaacgtgcctgggtccaggccagcaattggcttctttcagacactattgactgcaacaaaccctagcacaaggagagggtctaacgagaaacttgttcagaggatgctgacccatccatcagtgagcacagccaacccaaaaaggcggggacgcggcagagcaggggctgagggcacacttgctgcagtgttcacggagcacacacagaaagatctgcccgagagagtccccaaaaggcacaattctacaaggtcaaccaagtggaggggaatggcagtgaaacgccaaactcctactgaaaggttgatgggtacagccttccagagacagggctgggtggcgggaacgcgggcacccagaggtccagatcagcaaaagaggccagtgactctgtctccatcagataaaattcagccacagcgggagggagcgtgtgagacccacgaaggccttgccctggacctacacctcaccctgttccagagagaattcagtggccggcaacactgccagttcccctttatttcccttgaggtcaacattttggaattttctactcacatccaccgagcgaccctcctcggccacctccacacccacactccaggcccaccactgcccttgggcatgagcaagcctgacgctgtctctcatcctggtaacaccttcttccccgcacacaccgtcaaacacatgcacggtgtagactgaagtcatcaggtctccttaaccaggctgcagtcccctagtaccctgccatgcagccccacagctgccggggggataaacaagcaccttcagactagagcagcttctgagtgatacgcaaagttaactggggcacagagaaaacagaattttcccaagattgctgaaggaaaactaaaaccgaatgaggactgactcatgctcgtttagtcggccacaggctaggggcagcggaaaggccctgctggaaatttccatccagggtctgtgcagggcgggtaccccagagccgcagggcagggcagatggctcctcagatcgggctggagagacatccaggaggaggatgccagttgttgggtgtagctggaccttcctatagacagggagccatgggaagacagagaccactgatgaggaaggggagatgcagcagcagacactccgtccacatgggccccgggccgccagagaccccagggcccacgtggacgtgtgggtgttgaagggtaacacgtagccctttccaaggtgtgttgatgacttggctcagcctgcaaagccaggctgcctgtactgctgcctgacctctggcctctggcctccaagagcctgaccctctgggaagacagagtcccagcatggggcatgaccaccccatctgctcttcctgttcatcagtgtctggacctgagccacagagtcctgctgggccattgtggagaagaacctgctctcagccctcagcagcctccctgccctgccctgcctcccaccccaatctcaacagcctcttgctcttttcttcccgccatctaagctcatttctcctctttgggccttcatacatgggtactgctttgctagaaatctctcaattttacctctctgtgtggtgggacaccagaagaaacaaggttgagtttgggtgctggaatttggaggaacatgtaaacactttttctgctgtagttgtagaggtgcttgaataagaatgttcaggctgggcatggtggctcacacctgtaatcccagcactctgggaggccgagtcaggtggatcacctgaggtcaggagttcgagaccagcctgaccaacgtggagaaaccccgtctctactaaaaatacaaaattagccgggcgcggtggcacatgcctgtaatcccagctacttgggaggccaaggcaggagaatcgcttgagcccaggaggcggaggttgcagtgagccaagatcgtgccattgctctccagcctgggagacaagagggaaactcagtctcaaaaaaaaaaaaaaaaaaaaaaaaagaatgtttaaaaagagttaaaaatgttttccttcttcctattttatcgccctgcctctctttctttgttggagcccatatggaggggacagaagacaaggccttacagctgtacattaggcaggggcaccaggaggaggtccaggcactgatgagaaaggcataaaggcacagttaatgccagctcatatgatccatcgtggctgttgtcccgcctcatgcacagggggtgttggggaagaaacaatctctctggcccagagggatacttagagtgcttcttctatctctagggccttccatggcctcagagcacatgtgtcacaccacagaaagccaacccagcaactcagagagaaatggttttagaaatctaagaagcaagagaaacaaatcctcctgggaaaggagctcatgtgcagtgcctgagtgtgggtctctctacagttctccacttttttctcttccacacgtctctgtcactttcacttgtcatttgtgtatacttttcctacatcagttaaaaaaggttcccaccacccaccaaacccgctgccagaacactcctggacagagaggacacaagcagtcactgctgttttttgcaaattagaaacttggcaggtatcctgtgagtatcaaaggagatcatccacatgacacgtctagcccaatcattgcccttctttccccttgttgcccactaacctgggctcctagccctatccgatcctcggagactgggcctttggtgacccacaaacctcacggccatggagacgaacagttcctccatagctccctatacttcctcactcctgggcacccagggctccttccccagtgagcacggcgtcttgcacacagccggctttcccttatctgcatggcacctgtcactctgtctaccaatttccagcagggaatctgattgcccaccagccaccattcagtctaacaagaactccttggcaattagaggaatttggaacgctccagcaagctcactgaactgatctctttttaagcacccattgttttctctgcagtaatttttttctttcagcagcttttctagcccctatttcttaacatttcctaaaatgaaaatttcatttgtgtttttacttttgatcatttattaacagtctttggcttattctttagaggtttttaaccagcttctttcagtctttcggtagtattaccctgcaatctccttttctttcctgataccatttagcttttctgactttcaattaaaatatccttgctatccactgttgataggttatttatgtagtacttatacctctattaaaggagttaaattttggtttctggttttaaaaaagaaacaatctctctacctgaataatacaagtctctatgcctaagtatatctagaatgaataaaaataccaaattttaaaaaaggaaaaccagcaagattagatagcagtatatccttaaaaggtgtttcaagaacaaaaatcaggtaatattttaaagttactacttcaaaattccacgaagaaaggggcaatcttctgacatacattattaggcattctcccctctccaagcagaaactgagacaaactaggaaaaatgtgatagtgaaataagtgagatgcagctataaataaaagaagaaattgttgggtacagaccttagtctttgctttctgcataagcagtagttttgtggtaggcgtgggtttgggcgtgtaggtcttgggggaaggagcattgtacacattttacagtgttcctgccctcctgagacagctgtggctcttgcttccccaggggtcagggtccatgttcccacctcatgttgtttatttattttgaggccagagtgcagtggcaccatctcagctcactgcaacctctgcctcccaggttcaagtgattctcgtgcctcagcctcccaagtagctgggattacaggcgtgcaccaccacgcccgcctaattttttgcatttttagtagatacggggtttcaccacgttggccaggccggtatcggactcctgacctcaagtgatctgcctgcctcggcctctgaaagtgctgggattacaggcgatgttcccacctgatgttctatcatttcaaagaatgcactgaatattgggggacttcagggactgtcacttttgctttaaaaactgtaaagtgaatctaggaaaagctttttttttttctggtttctccaccatcagtttgcatgagaaacgccaatcataggactgctgggaatggccccttagctgtgctgtttctgagccaggcctacatcctccactggcttccttgggcgaattttaaggcctatgagcactggagttgtgcatggaggtgggggccaacaggaagtccattgtcctaaatagtcatttcagcctaactaaccccatggtgaggctgctcattaacaggcaaggcatcactgtaaaccttgcatttgcatttacacctactatttattaagtgccacagccatctcttatcatgaccggtcactgagcaaaccctacatttcaaaaacaatccagtttataggtcctctgtctgtttctccgggctggaaaaggctttccatttatcaacttagttgtccccccagtcgcctcttgcagggaacagggccagatcagatggcggctggttcccctcccccgcctcatacaaaaatcaggaaaaggagttgcgggaggaatcgagaagccggccgcagagcccaggtcccccatggctactgtgaggcattcgccgctgcaaatttcctgtccactgtgggaagcggcacacctcactcatgagcagacgacaggactggcacgttttaatggagcacacgggcgcagcctaggcggccttttgctccggctgagaggcacgggcccggtgccagcatttgacagtcctgggaggcgacgggtagaggagagacgcggcagccgcggggccggggagacggtgggaggcccggcgtccatcatccactttattacttgatcaaactttaacattttcgggtttcctaacaccttagccccaaatactcgaaatgaagcaaatcttaaattaaggagtctttccccaccacgctctgtcctcctccccacttcaccctcccgccgtttcgcgttatttccaaggcaatttaaaaaatcaagccaaacaaagctccccggttgctgccgggcgcgcgcggcgaacgaagcacatttcagttcagcaccagcctcggggacagacgccatcaaggaggtgaggaaaaccaccctcagctgcggtggctccagcgtcaccccgagtgctcccgaggcggcgtctgggctgctggggagccaggagggcttcctcaggcactcgccagaaacatttccccaaagaaaacgcccaaccagccacgccatctcctgccactgaggtccttttccacgggggacgtccccgctgggaaaacagcaaacgctctgtgacctacaaatggaagaggggacccccgagcccccgcctgcctcatgccggagggaccgggcgcccccagccccggaagcccctggacgcgctccgagggggctgtccacacccgcgcgcgggcttccccggggcccggcgggaggtcccgggagaggaggccgagggaaccacaggtctttgtgtcgcgtgcagcagcagctggcggcgtgaggaccacaccggcgccagagccgtctccctaggtccggagactttcaccccgagtttcccttccgcgtctggctgcaccgggctgggctctccccgcggacacccggggctccggccgggcgcccacttacccggagcgggatcacgcgcgggcttcgtctgcagcgcggtgctcgcggggggcggccaggccgagcggcatcgctccgcatcggggcgcgggccgggctcgggtgcaaacgcgcgcctcgtgcccctcccgccgcccgcggggtctccgcgtcccgtcaccggccccgccccgcgccgcgcctcccgccctgcagggcccgaccacgcgggcctgggggcgcaggcggaccctcccccggccctggacgctgggggcttctgctcggccccctgtgccgtgggggcccagactggggaagggagagccggcgactctgcgaccctcgcccccgttccacgctggccgcgcccactccgccgcggggtctcgcccgggaaatcccgcccgctgccaccgacgtcactgctgcgtcaccggggctcccgcgctccccgcccccgcccccgccccagcccgggcccgcgccccccgcccgctactcgggcccacgccccctgtcccagcaaagggccgcgcccccgccccgcccccccggagcccgcgtggccgggggaccactggaggggtctgtggggcggggccggggggtaaatcactgggggggggtctggggggcgcggcgggggggagatcactggagggatctgcggggcggggccgggggggaaatcaccggaggggtctggggcggggccggggttgctggaggggtctggggacggggccgcggtcagcgcgggctccccgaagcctcaggtaccgccctcgctcggggtgagctccagcgcctgggccgttggggcgcgggccgcttcccaccctgcaccaagggacgcctcggaagcctccggccaaggcggggaacggcggagaaacgcggaatacctgtgcgaattcgcgcggccgcgtcgccactaacccggcgaaggctgacccgacgttgctgagtgacggggaccaggggccggcgaggcccccactccggggggagcgaggccgggagggcggagggcgcgtgctggaggcgggggtgcccttcgcgccccggttctaggagcgactgctctccaggcctcgtccctgtggcaccg

SEQ ID NO: 2506 - DNA, 102310 bp, Homo sapiens
attgctagtcacaaagcccaactttttattgaagtataacatacacacagaaaagtgcccagatcaaaagtgtacagctccaagaatgttcacaaacggaaagcacccaggtaaccggcaaccagatcaagaaacagaacaccccagaagcaccacctcatgcccgcttctggttactgtcttcttaggactgatctctacttgcaaccgcatggatgaattttgctgggttttaaactttatataaatggaatcctatggtgcatttttgccttatctcgttcaacactagggttggtgaatacactccaagttgggggtggagttgcagctcattcccattgcagtctgggattccatcgtgtgaatataccctaatgtgcttatccagccaacatgggcattggggtgctttcctgttcggggttattatggagagtgtttttgtgaagatttagagcatgtctctggatgaacacatgtacacatttctgtagggtatacacctaggggtggaattgttaggtcatatatatttacatccaactcaagctctttcatgaaagaagaaagaatgtactggatggagtttgctggctcaaagaattgacagaaaactagaagggaggtctgtaggaagataggtggaggcggagacagctcagcgagtccaaggagtggagcagaaatgacattcccaggacgctgccatccctggacattgctaccagtggacacaccatccctgcagcctgccagccctacccacctgccttgctgtatgactaccaaccccggaccacggtggcttccttgaaatgagtctcagcatcccttcatttgtgtcacattctccaggctcatagccccaagcaagggtccaggtagtccaccccaggtcaatgaccacttcccgactggtatggggctggaagcggggtgtgcctgagagacaggaaatacttcccttcttcagcttccacggtgggtactgcacaccactaagtttatatctaaggcatgatgtccctgctgtaggaagggaggggagatgctggacagttaagctgaaaacacaaaaatgacaactgtccccacagctgcactccacaatgcaagcaggctttattccattcatcttccactgacagagtgggggagctcagtgacatgtctgtggatctcacagctcatgtgcagaaatctccatctaagaagagggaactaggccaggcgcggtggctcatgcctgtaatcccagcactttgggaggccaaggcgggcggatcacttgaggtctgggcttcaagaccagcgtggccaacatggtgaaactccgtctctactaaaaatacaaaaattagccgggtgtggtggcgggcgcctgcaatcccagctcctcgtgaggttgaggcacaagaatcgcttgaacccaggaggcagaggttgcagtgagccaagattgcgctactgcactccagcctggacgacagaaagagactctgtctcaaaaacaaaaacaaaaacaaaaaaagaagaggcagctggattcaggatcactctaggaagggtgacccgtccccaaatgccataggtctggaagaggtgcagtaaaaggacagaaaagcatctcacaggggaaggtaaggaagagaggaggaaaaggaaaaggagagagaacaaaacggaggctgaatctggagggacggggcatgtaaaaacaacagggagaaggtttggtggaagaggaaagcagcatttttctgacctgattttgatgctctctgtacggccccgctttctcggcttctctgatgtgcctttatgacttgtgcttcgcttcatcgggttaatgatgttgacgtgaagcacagaataaagagatcctggtcataactgcactatcaaaggatctgaggtcctagcgtcacatccagcatacaattctgctctagtttgagcatcttaacaacactggtattattagtgagctgataatgaaactaagaatgagttttaacaaaagaagcaaggaacaaagatgtcctaaatccatttacgagggcagcaagtcattaattggtctggaaattacatttgcctctttgcaggcaattttatgcctccaacggaaccatggtctctttgaagtcatccattcttccctatattataccacggcatttagtacatttatttgttttaaatgataatcagagctttcatctatgtagcatctctgtttcctcccagacagaaaggcaggataattaccattaaacccaatttgcaggttagaacatttcaggcacaaatggcctgttctctatcacacagcaagtctctttcagaactagggagagaggcagtttccaaataaacagaatagaacaaacttacacaaagagctctgctcccactgtgtattctcctctttcatcgggatcatatgagtttggtttaggtaggaccttcaggttgatcttagacaatccaagagctaattcatcgatgtctagcctttccttggggcatccatgaatcaccttccttaaactaccagaatacggcttcctcctggagaatgtgggaagtgaagtgtgccacgggttactgcaacaaaggtgtttgcttcacggtgtgcagttatgatagtttgtgggtctccctacctgcaaacaggtagacctggaaggtagcacagttcagggggctaagggaactctggggccgggctgcctgccctcaaatcccagtttttctgcttaccatgtgtaaccttgggcaaactacataaacgctttgtgcctcagtttcccctcactctaagacatacggccgggtgcactggctcacacctgcaatcccagcactttgggaggccaaggtgggcagatcactcgaggccagtagttggagaccagcctggccgacatggtgaaaccccgtctctactaaaaatacaaaaatgagccaggcatgttggcgtgtgcttgtcatcccagctactagggaggctgagacatgaggatcacttgaacctgcgagtggaggttgcggtgagctgagattgtgccattgcattccagcccgggcgacagagcaagactctgtctcaaaaagataaataaataaaataaaacagacatgcacttatggtatttattgttggaagattgagtaccttaatgcacaccaatgctcagatgacttgggggcacataggggactgctgtcaccatgcctcactcctgcagggaaggggctgccctactaaaaccccagcgggcccagtgctgtgtccagaacaggtccttatattactgcagcccacaatggaactactgagtaggagccaaaagaggagggagcaggaagaggtggcatttggagaggggagaccgcacccacaggtctgccacagcgcgtcaacggtatggggtacttttacagtcaagttgacttcggtgtccgcccaccatctacctttgtaggaccactgaaacaagggacatccaccacggcccacagccggggcgccacggccccaggaggatatgctaagaaaaccattccacggccgggtgtggtggctcacgcctgtaatcccagcgctttgggaggccgaggcgggtggatcacgaggtcaggagtttgagaccagcctgaccaacatggtgaaaccccgtctttactaaaaatacaaaaaattagctgggtgtggtggcgcgtgcctatgatcccagctactcaggaggctgaggcaggagaatcgcttgaacccaggaggtggaggtcgcagtgagctgaggtcacgccattgcactccagcctgggtgacagagcgagactccatctcaaaacaacaacaacaacaaaaaaaaaacaaaagaaaaccattccaatcctgtgggttgttgtctttttactaggatgatggaaatgcaggaaatacagaacctctgcagctgctttctccaggaaaggagatgaaaacgttatatgtttcagttggtcaaaatgctctaatttgatactgaatattgcaaataagggatatttaggcatagttttttttttaaaataaattatccactgaaatgtattaatatgatataaacttggaaactgatgtttaaaaattttaaactcttaagtccagacttacttttacatggcacatttgttatttggctataaacattttgattttctttgccaataatgaaaataacatgaaaatgaaaaggaaaaaaatgaaattgaatgccacgaagaaaacagatggaaacataagacaagccccggccactgttggctgggcagggatgggtgttggtctcactccctaaggcttagagcatgcatggtctctacaggggactttgaaggtcagaaaaggaggcgttttcatcacacacggagttagagaatggtacaaaagaacttcttctcgcgaaaggggttttctgatgcaggcactggaatgatgagaggatcttcccgcacgtgagcttcacagtaggccaggaggtccgcagctgcctgggagacctgtgagggcacagagcacaggtgctcagttaaaggcccctttgcagagtgagtccagggaagaggtgtccacgtacagaggggacaagccctagggtaggctgtattgtgtgcacggcctacaacatggtcatgcccaggctggagggagggtttgtgcagatctaggagactggttcgaagcgggcctccaagaaggggaggctgccctcgcatggcaggccagcatggagacaggactgagggctggcaggaggcccagacagccttgatatattctcgagtaggtgaggagtggaggttccaggacagtagtctcacaatgactttgctaaaccgtttctggaagactaaagcagaaggcagcccctggccaagccagtgtgatcatatttattatcattattagttgttttattgcaatccactcttgtgaccaacacagagagacacttcatcctcctcaacagaacttgtatttagctatattttataagcacacgttttatttttattcatttttcatttttatttctttttttgaggcagagtctcgctctgttgcccaggctagagtgtggtggcgtgatctccgctcactgcaacctccatctcctgggttcaagtgatgctcctgcctcagtctcccaagtagctgagattacaggcactcaccatgcccagctaatttttgtatttttagtagagatggggtttcactatgttggccaggctggtctcaaactcctgacctcaggtgatctgcccacctcggcttcccaaagtgctgggattacaggcatgagccaccgtgcccagccagcacacatgttttaacttggagtggccacttccctgcggagagaggtgctcctgaccagaaagttctttccattccatttctttccaggcttatctgaagcctgctggcgcatggcagttgtgcatcaaactgtccccaagctcaaggccagaggaagagcaggttgggagagggcggggtgcggacaagcatttgctaagagggagaggcagttaccagcttattttgttcatggtctgtgtcatgtgcttggcagataaatggcctgtgcattaactcatcctgccaattaggctgttctgcctgcgagtatttattagcggattacaggcaggggtaaatacatagcagtcaaatgaaatccttttagtacattcaatgtctaaatcttccccagaatgataaaaatgttccacagatgaagaaaaaaaatgtttagaagcctccagctacacaggccatacacattcccttctgggttttaaaaattggctcatctttcagcattttacagagattcttctgattttcagacctaaccgctttagcaatggctagaaataattccagcagagatatacaatgaatcaactaaacacatcactcaaataaatcaacttgaagtttagcagatgagttagtctaaatcctgacaaaacctacatttgttaagaatgtggcatggagaaatgagttccggtgaacatcaggcttctagatctacccccgcccgtaagctagctgtgtgaccttgggtaagcagctcaacctttctgagcttcacttccctcatttgtaaaattcaggagcgttggagagctctaaggtcccaatttactctaagacgtctatgattctacctttaatagcatggtcagtatttaagatcctaaaaacgtgtatgttgagttgaataggagtgtttgaagtttgcagtgggttacaggacgcccatataggaatttcccagatgggtgaggctcaggggaaaactgagcctgtggggggcctgtgaagccatcacaaggagcaggagcacaggcttaaggaaatggactctgaggcccacagggctgcgatggacacacaagagaatggaatcacatggtgagtgctgcaactcaaagccggtggacttgggagattgagccctcccttgctgccaccttctaaggaaagccaagtgccctccccaactgctggagtgatgacctccttagtttccactcctggcttctcaccatgcccagagatgcagaagctgctgaggtctggggtctccctcatggccaccatgttaggacagccactaaattcatccattgacccctctggcaacccctgggcagtggtcttcactgctgcctgggcagcacacacaagggctgcagtgttggaacaaccacattcctcctctaggagccactgtcctcttgggtttgctaagtctaggcccctgactccagtgagctcttctgggagttccgtttaagaatggctcggctggacgcagtggctcacacctgtaatcccagcactttgggaggccaaggcgggtggatcgcctgaggtcaggagttcaagaccagcctggccaacatggtgaaaccccgtctctacaaaaaatacaaaaaattagccaggcgtggtggcgggtgcctgtaatcccagctactcaggaggctgaggcaggagaatcgcttgaactcgggagttggaagttgcaatgagctgagattgtgccactgcactccagtctgggcaacaagagtgaaactccatctcaaaaaaaaaaaaaaaaaaaaagaacgtctcgtctgactatcatgccctctccagttttctagttttcacttttcccatctacttcattttttttggacatgctccagtttcatctgaattctctataatcctcgttatgtcattcagaaaggaagtattcactatctaccctttagctaattcagaggatgcaagagaaagaataaggcaacagttttgccctctagaagatctcactgtgatctcaaacatgatgaagtcactataataatccatgtgtgctgaaatgtcacaaaagaacacttgcacgccactgtggatccatgatgagaggccaggagacggggcatctgacaacctgtccagtcccagacagtagaggacaccttggtgaatctgccccctttcttcagagggcaatcactggacttctgggcccagaaacacaatttcctggcacactcagaatagatcatctcttgtggctgacccatattaaacaagctcaggaggcagctggataaaaccataatacaaatagaagctaacatttacatttactgagtgcttctcaggtgccagcactatgctacatgcatcagatgtattatgtcatttaattcttcttatacgtacgactctagcctgggcaacataacaagactctaccataaaatgaaaaaattagccaggcatgatagtgcacaccggcagtcccagctacttgggaggctgaggcagggacatcgcttgagtccgggagttcaaggctgcagtgagctgtgatcgcaccactgcacaccagcctgggtggcagagcaagaccctgtctctaaaaaaaaaaaaaaaaagtagaattccttatttataattgacaaataaaaatggaatatatttatggtgtacaacatgatgttttgatacgtgtatacattatagaatggctaaatcaagctaactgacatatctattacctcacatactttttttgtggttaaaaacataaaatttactcttttagcaattttcttttttcttttgagatggagtctcactctgccatccagactggagtgcagtagggcgatctcagctcactgtaacctctgcctcctggtttcaaacagttttcctgcctcagccttctagtagctggggttacaggctcctgccaccatgcctggctaatttttaaatttttggtagagatggggtttctccatgttggccgggctggtctcgaactcctgacctcaggtgatctgcccgcctcggcctctcaaagtgctgggattacaggcatgagcctctgagtctggcaagcaattttcaagtacacatgataagtattatcttaaagccactttacagatgaggaaactgaggcacaaaggttaagaaggtcacccatctattaagagaggaaaccagggccgggcacggtggctcacggactgtaatcccagcactttggggggccgaggcaggcagatcacaaaatcaggagctcaagaacatcctggccaacatggtgaaaccccgtctctactaaaaatacaaaatttagctgggcgtggtggcccatgcctgtaatcccagctactcgggaggctgaggcaggagaattgcttgaaccagggagtcagaggttgcagtgagctgaggtcgcgccactgcactccagcctggcgacagagtgagactctgtctcaaaaaaaaaaaaaaaaaaaaaagagacagccagaatttgaagctaagctgtactgtactacagccgtccccaacgttttcggcacgagggagtggtttcgtggaagacagtttttccatgaactgggggtggggggatggtttcaggaggattcaagtgcattagatttatcgtacactttatttctgttattattacattgtaatacataatgaaataattatatacaattcaccataatgcagaatcaatgggaggcctgagcttgtttttctgcaactagatggtcccatttggaggtgatgggagacagtgacagataatcagacacaggattctcataaggagcttgcaacctagatccctcacacgcgcagttcacaattgggtttgtgctcctgtaagaatctaatgccgctgctgatctcacaggaggcagagctcaagcggtaatgcaaccaatggggagcacctgtaaatacagatgaagctttgcttgctcacccgctgctcacttcctgctgtgcggcccggttcctaacaggccacagactggtactggtccatggcccggcggttggggacccgttttatactacacagaatctacactcgatacagaatctataatctacactgtatacagaatctatactcagccgctatactacagcagctgctttgttaattgacaatgagacccgtaattctcaagtggcctggaacattctcacctgcccatccatccagtgcacacgaggagagatccttgtggttcaactacctgggagctcacaggaccagaagaaggagagtctcccacctagagtgtcttaggtcatttcgtttaacctagagacaggaggtgtcctcagctgggactcaccccctttccccccggccctgagaagtacaggatggacacagccactgtggtctccaagacaccccttcctctaggctgtgacccgccaatccccttctgtctacacatacaatccagctggtcagaagttggctggctaaactgtcacgatagctctcttcccattgatcagtttacctgtcccggtggttatcaacatccatcatgggccagttcgactcttttaattctctaggagcaacctcaagggggcgcctcactggggaagctgcactatcaaccagtacatcctgtacatcatgaccaagcattaaaggagtgggctcaaaaaatgtcggggcttcgggggacagctcagtcgaggagaagtcaggttgggcccatgttccactccatagcagagtaacttcttcccttacagcccagtgtctgcaacaccctaacaattatgctattaatggtctggccttgccaggtctaagcaggtctcacctaggaatttttctctcacctcccaaaggtgatactgtacctgatgccacaatttttcttgcaagaaaacgagttgttcttagattgcctccttttgttgctttaagatcacagttgcgtttgctgagttataaccactcctctggcttgctgagtcctgtctgtgcacccatacaacaggaatgcacacacaatgaagccagtattactgccgatcaagaagtgctcagtttaagcccgaatgtgtggatctgggttggttccgtgaaacattaatttcctaggtgcactcagaattactgaaatgtaacactgtgaagaatggcccacttacgcacagctgcatctaatacagcataagtcatcttacagcaaaatagtcaagggagttttccaccttcatcaccccgtcttttcacatagcgtccagagtcctatataacctttataaccaaagtatcttgggtaacccctgaagtttattgttaatgtgatctgaaaagataaatataggtaatgaccgtctaaatgagcctgacacatgaaaggtggcgtcccaacaaatagctcagtatccaggtattaattaacctgagtctgctccttccgctgagagggagagttttcttaatcagccctagattgatgtttatggttggaggtttccttcaacacgtaccaaataggggttgcagacaacgccagatcccattaaacatctgccatctttggaacataaagtagacaatttgctttcaaagagaaaatcttattctggtagaaaattgcaaattcctttactgtgtatcctttctcatcaagcctgaattcggctttccctcaagttcactgtgatgaaatgcctggagcatctctgtgcctccccgtcttagtattgaactgttagagttacaagacaacagatgttgaaaagaattggtagcttgggaacaactgtggaattttaccatcacatttcagagtaaaagaggtgattaaggcagcccaagttagcacgtaatcctgttagttgcactataattacaagcttcaatgatgggagaaaatgccgcaattactatagtcacattccatgacaagacagatgacataattattattgtggctgtgacacccactgcatttatcctttgcatctgaagtagacagacccacacctatttctaagcaacgctggtctatttaacagtactactgggaatcaaaagcatcttggttggctttgcctgtttctcctactccaagaaaacaaagcaggattacagttaatggtacagccaggttgcagccagcatggtgtaacggtatattttacaaggtctataatggtatatttttacacggtgaaatttggtgcacactccactagaagatatcatatactgcttatcctcagtgggatcctggggacattacaggtatatacctcacctttaaattctcagaaagcactgcagggtgaactcttgtgcttttttttttctcctaacattgggaagtatttgagacccacacaccagttcctaagggcagtctctagatactttcatattatggctttcagaggatcccagtaactacttcgtactattcctggtcagtgtgggcaattcttacttgttggcggatggcctgtgtggggagaggcttccgccctgtgggtgggtcctaggccacaggcaacatcaagcttagagtgggttaggttatacctgaaggtggaaaccagagagaggagggtgggtgatatgtgtgaataaaagaataattcaacagagtccgtctctgaacccttaagtcaaatgtccatagcagcagactagccactgttaactactttcagcataggctttttttccacatcaaaagttgattgcacattgggagctaaatctaagatgcttgaaagagagttgtaatatcaccaaattaacttaagtaagagttgttctgacatggccttcagcacaggaatatcaaagccctcacttgtttagaatatgattgacctagatccaccctggaccttgacttaaccaagcccgttcaacaggtcagtgtttgtcccatctgactgactatctctcagttttgatatttcccaaatttccaaaaagaaatccataattccatcactttgcaagtttgccatgctggataagatggacactccaggcactcagctttgactcctgtaaacgagaacggcaacacctgctggtttgtggctaaatggatgccatcatatattgccgtggtttgaaagtgctgtctcccaaaagcatgttctggaaacaatgcgagcatgttaggaggtgaggcctaatgagaagttattaggtgatgagggctctgttctcatgaatggattaatgctgttatcatgggaatgggctccttataaaaggatgggtttggccccttttttctctctctgcctctctccttgcccttccgccatctgctgtggggtgacactgcaagtagcccctcaccagaggtagccctttcccagcccccagaactatgagttaataaatttctgtgcatcataaattacccagtctgtggtattctgttacagcagcacaagccaactgaaacataagcacatggggttattaatccattattcatttggctactttctagtaggacagagaagatacttgagaaacagacacgaagaagtttctcagaaattattagggcattggatgcccacaatggccctgaccagatcatccccatgaatagaagagatccctttctaagtgcaactttcattttcttcttctactactcatgttctactctttcatttaatccgaagcattttccccttttatctgatcccagttctagaactgctcatcctaataacctttcctcaatatggccagatttttggattttagccattctaataggtgtgtagtggtatcttattgttttaatttgtaattctctagtgacatgatgttgaacatgttttcatacgcttattttccatttgtatgtcatcttttgtgatgtgtctgatcagaaattttgcccttttcttttttcttttgagacggagtctcactctgtcgccaggctgcagtgcagtggcgccatctcggctcactgcaagctccacctcacgggttcaagacattctcctgcctcagcctcccgagtagctgggactacaggcgcctgccaccacggccggctaattttttgtatttttagtagagacggggtttcaccgtgttagccagcatggtctcgatctcctgacctcgtgatccgcccacctcggcctcccaaagtgttgggattacaggtgtgagccaccgcgcccggccattttgcccattttttaatgtggttggttgttttctcattgttgtgttttaagggttctctctctcttgctctcttgcacgcgctcgcgctctctctctctatatatatacattttttttttctagacgagtcttgctctgccacccggctggactgcagtggtgcaacctccacctctggggttcaagtgatctcccacctcagcttcctgagtggctgggattgcaggcacctgccaccatgcctagctaatttttgtatttttagtagagatggggtttcaccatattggccaggctggtttcaaactcctgacctcaggtgatctgcctgcctcagcctcccaacgtgctgggattacaggcgagagccaccgcacttggccctttatatattttggatacaagtcttttatcaggcatgtgtttgacaaatattttctcccagcgtgtggcttgtgttcattcccttaacagtgcttttcactgaagtcttaaattttactgtaatctagcttgtctacttttttctttgatggattgtgcttttgctgttgtatctaaaaactctttgccaaacccaaggtcacttagatttcctatgtcatcttctagaagttctgtagtgtactcttttatatttatgtctataatttattttgagttaatttttataaaatgtaaaaggtctgtgtctagattcattttctgcatgtggatgttcagttgttcttacagtatttgttgaaaagactatctttgcttcatggtattggctttgcacctttgtcaaagatcagctggctatatttacatgggtctattttggggctctctattctgttccactgacctacacgtctactctttcaccaataccacattgtcttaattactgtagttttatagtaagtctttcagtcaggtagtgtcggttctccaactttgttcttctccttcagtattttattggctattctgggtcttttggctttccatataaactttaaaatcattttgtcaatatccacaagataagatttgctgggattttggggtggggcacagcagctcatgcctgtaatcccagcactttgggaggtcgaggcaggtggatcacttgaggtcaggagttcaagaccagcctggccaatatggcgaaaccccatctctactaaaaatacaaaaattagctgctgggcatggtgggcctgtaatcccaactactcaggaggctgaggcaggagagttgcttgaatctgggaggcagaggttgcagagagccaagatggcaccactgcactccagcttgggcaacagagcaaggctctgtctcaagaaaaaaaaaaagaaaaaaaaaaaaagaaaaaaaaaaaagaagaaaatttgctgggattctgattgggatcacattgaatctacagatcaagttgggaaaaactgctattttaactatattgagtcttcttatccatgaacatggactatctctccatttatttagatgtttgattttttcctcagagttttgtagttttcctcatatagatcttgtgcatattgaatatatctgatatatttttgcccatctttttacattcaacctgagtcactttattttaggtctatgtctaatgcaaaatatattctttttaaaggttaaatctgataatctaaattagttttcccacttaacacttattattaagatagatgtatttggtattgtttctgctgtcttattttgtcttttgaaacttttacattctcttttgttttctgttgatgttccatggtctttatttcttgtactccagtaattaagaagtataggccaggcgtgatggctcatgcctgtaatcccagcactttgggaggctgaggtgggcgggtcacttaaggtcaggagtttgagaccagcctggccaacatagtgaaaccccatctctactaaaattacaaaaattagccgggcgtagcggtgcgcacctgtagtcccagctacttgggattgcttgaacccagaggcagaggttgcagtgagcagagatcgccccacggcattccagcctggacaacagagtgaaactgtctcaaaaaaaaaaaaaaaaaaaaaaaaaaaaagcgttttatctttatagccttaatatgtttataatgttaatcaatttcagaaatgaagttatattgattgattcacatctatgaaatatgaggaaattggctatactggacaattatcatgcatgttttcccccagcaactgaaccccttctctggttggaggaatgatctactttatgagtcctcgtgtggggaaacaattatttctcttaatagatctgaaaatgttaaatactcaccttcccagaatcttgcaacttggcacatgtgactttgtttctgtctatctgacacacatgtgccagactttggtgaatgatctgagggaaaagacattaggagcttttgttctggtggcagtggtcctgactagaaggttgagttcctggctcagagtgatagtggtataaactgtagcatgtagtgctgggtggtgattgcagcagttccttcctcagactgttctgcagtgtggttttgagtgctgttcccagaagatgaatcttaagcccacttctctagactttccagcaattttataagctattcaaaatccctttaataaattccttttataatcaacctagatgcttaccaacagtggactggataagaaaatgtagtatatatacaccatgaaatacaatgcagctataaaaatgaatgaaattgtgtcctttgcagcagtatgaatacagctggcggccattatcctaattgaattaatgcaggaacagaaaaccaaatgccacacgttctcatttataactgggagctaaatattgagtacacatggtcacaaagatgggaataggagacaccaggaacgagagacacactacttgaggggtgatggggggaggaaggtaagggctgaaaaactacctgttgggtactatgctgactacctgggggatgaaatcactggtgcaccaaaccctactgacatccaatttacccacttaacaaacttgcacatgtaccccttgaaactaaaattaaagttgaaactaaccaactaactaaattccttttatgtttactcagccagggtaagcttctgttatttgtaataaagactcttggactgacaggttgccatatttatactctcctctcttctccctcccctattttaatgtaagtattttctaggattgtcatagtctactactgacaaatatttatttttacatcatatagatttctgagaagaatgataaaaattacatttttttaagagtggtcatcatagttattattattttttttagacagagtctagctctgttgcccaggctggagtgcagtggcacaatctcagctcactgcaacctctgcctcccgggttcaagcgattcttctgcctcagccccccgagtagctgggaccacaggcgtgtgcctccacgcccggcttattttggtattcttagtagagatggggtttcaccatgttggccaggatggtcttgatctcttgacctgtgatccgcccaccttggcctcccaaaatgctgggattacaggcgtgagccacagcgcccagccagttattcttaattctaagtttacattgattgaataaccctgcaacttctttcctaccatgccatccccgtgtggaagttatttcgattcagtcagctggctggatcccatgttacacacatgtatgtgcagagtccagaggaggcaggagaccactcgggccatggtgctggcaagaatcctgaacaggaaggtcgtctctgagcaagtcagaggctaaagaaagagggtggcagttggcccagcgcagtggcatgcctgtaatcccagcaatttgggaggccgaggtgggcggatcacctgaggtcaggagttcgaaaccagcctggccaacatggtgaaaccccatctctactaaaaatacaaaaattagccgggcatggtggtgatgggcgcctgtaatcccaactactcaggaggctgatgcaggagaatcacttgaacccaggaggaggaggctgcagtgagccgagatcgtgccactgcactctagcctgggcttgtgacagagtgagactctgtttcaaaaaacaaacaaacaagcaacaacaacaaaaaacacaatatggcagtgactagaagatccccaaaggtcctgggaataaagaacaaccacaatgggctggtgcaagctcttcgtcaggctcccaaggtgagagaattgcttgagctcaggagttgagagcagtctggcaaacatagcgagacccccgtctctattaaattttttttcaattagctggacatggtggtatgtgcctacttaggtttgcttaggtttgacagcttctcagggtggaacttttgaaatacgaggcagtagactgcccagtcgttcctatggagttcatcatcagcctcacaggtgacctagtgttctttttggggcagctgctgatgtttgtgcattccatgagctgacacagagggacagaggtcccttttaccatttggtatcttcagtcaatggagtaagaaagttgtctgatacccaaatctgaaggctattaagagtgagaattgagaatctgactctatcacactgataaagaattgagcagaattctaggactgaatattgacccagaaactataacttggcagagagcatttgaatcccagtgatagactttggaggcagatcacctttggagagtggtgactcacactgatgtctccatggtgagtgaaatcgtgagtgttctgtctttcaacagtgctctaaacaggggtctccaaccccctgccagggaccagtaccagtccatggcctgttaggaagcaggctgcacagcaggaggtgagcggccagcgagtgagcattaccgcctgagctccgcctcctgtcagatcagcggaggccttagattcccataggagcgtgaaccctattgtcaactgcgcatgcaaggaatctagcttgcatgctccttatgagaacctaatgcctgatgatctgtcactgtctcccaacacctgtcctgtctagttgcaggaaaacaagcttagggcttccactgattctacattatggtgagtatgtaataataatagcaataaagtgcataataaatgtaatgcttgaatcatccccaaaccgtcccccatgacctgtggaaaaactgtctcccatgaaaccagttcctagtgccaaaaagggtggggaccgctgctctaaaagataggagagactgaggaaaatggcggtgctatctaatgagaacggggatgctaccagtgctgaagatctgggtgtgagtggtgccttgacaagtgctatgaaggatgcatcaagcccagtctcatacagactcagagggaatgctaatattcatctgatggacatgaagccctctagcacagcaggtccaacagcacgaagacttgttggttctgaatgctctatagcgatggaagctggatttggagataactttgtcttgaaagcagtttttttaaagtattattattattattgaaataaagtcttgctctgttgccctggctggagtgcagtggtgagatcataactcaaagcagcctctgtcttctgggctcaagtgatcctcccacctcagcctcctaagtaggcacataccaccatgtccagctaattaaaaaaaaaaaatttagtagagatgtggtctcgctatgtttcccagactggtctcaaactcctgagctcaagcaattctcccaccttggcctcccaaagtgccaggattacagacttgagccactgcacccggcataaaaaaatgtttaattataggactatatgtttatacaaatatatgtgtacatatatacacatatatgtgtatttctataaaacatacatgacatcaaatgcatcgtcttaactatttttaagtatatagttcagtagtattaagtattttcacattcttgtgcaactatcagtaccatccgtctccagaacttgcaaaactgaaactctgtttccattaaacaaccctccattctctccttcccccaggccctggagaacaccattctcctgtctgtttctatgaatttgactcctctaggtacctcatataggtggaacacaatattttgtctttttgtgcctggcttatttctcttagcatagtgtcctcaaggttcattcatgttgtcccacatgtctgagtttccttcctgtttaaggctgaataattttctgttttaagtatacactacattttgtttatccatttatctgttgatagacatttaggtagcttctatgccttggctattgtgaataaactgctattaatatggatgtacagatctctcttcaagaccctacttccaattcttttgagtctattcataggtgatacatggattgtctcacccgatcccatttctataatattgatttgggctctgtggaatcctgataaataagcaacaatgaggaaggggtcccaggttggggagaacaattgttctgagagacggctaaccacaaacaggcccttgcacaacatcctgttccctcactctgcacgtagccccagcagcaggactgtaactgcacgaaccccctccagcatgaccctataaagcttccttccagcccctgcctttttggagacagtcccttttctgctgtgctgcccgttgcttccttgcaacatactttccttctaataaatctgcttttttttttttaaacctatgactgccttggcaaattcctttagcactcatgatccccgctctagtcatcacacctgcaacaggccctgcatcaaaacaggtgactgagctgttccaagtacatcaagcccatccttcagtgccttcaatgcctcctatgactcagattgtgtgtggatccagccatgtgcaagaccctcagcccctgctcgggaagaccttttgactgagcaggcattttctcagctttcttatggtcttaatgtatattatcatgtgtaaattaacataattatgcacatctgtatctcctttagtgaaattcaatggaataaaataaaataagtttgctaaagaaaagcagcacatatttgcattacatttaaacttctgcataattgagaatatatctatgttgccatggacataaatggccacttggttgggtagagaattcattgtagatgctgtttctccttgggctgacatcttcagaactgtggggaagtgttgtccagactgatattttcctcctttgtgggtgaggcactgtagtgtaatgatagtacccaaggttctgggtttgtatccttccttcatcaaatgacaactctggacctcttttctttttctttcctttttttttttctttttttcttctcttttcttcttttcttttctcttttttgagatggagtcttgctctgttgtccaggctggagtgcagtggtgtgatcccggctcactgaaaccttctccgcctaggttcaagcaattctcctgcctcagccacccaagtagctgggactacaggtgctcaccaccaagcccggctaatttttgtatttttagtagagatggagtttcaccatgctggccaggctggtcttaaacttctgacctcttctgatcctcctgccttggcttcccaaagtgctgggacaacaggtgtgagccactgcacctggcctgggcctgttttcttgtctgtgaaatggggtactgatagcaccaacatctcagggctggtgtgaaaattcaagcacctaacacatattaagaatgtaccaaggctgggtgtgggggctcacgcctgtaatcctagcactctgggaggccaaggcgagtggattgtttgagctcaggagttagagaccgcctgggcaacatggcaaaacctagtcttagctatttgggaggctgaagtgggaggatagctcgagccgggaaggcggaagctgcagtgagccaagatcacgacactgcactccagcctgggtgacagagggagaccgtgtctcaaaaaaaaaaaaagaatgtaatcaaagttaggggtatttgtcctaactgactgcttcttctgcctatattcttttttttttgttgttttaagatggaattttgctcttgttgcccaggctggagtgcaatggcacgatcttggctcactagattcctcatgacctctttccttgtttactgaagcagtgtttgaacgcctcccaggttcaagcgattctcccacctcagcctcccgagtagctgggattacaggcgcccaccactacgcccagctcatttttgtattttcagtagacagggttttaccacattggccaggctggtctcgaactcctgacctcaggtgatccgtccgcctcggcctcccaaagtgctgggataacaggtgcgagccactgcgcctggcctcttctgcctatattcttaatgggctctttattattagtattgcttttgttttgctttttgctattgacttatttgttgatggagagatcactctttccttttgagattaagaccctcagctgtatttgtgtctgtgtcgatcatttctctcacactcttttctggaatacggcaagcagtttggacctgcagattcaggtcttcctttatttaatgaagctgttttatgttatatcctgaagagtattttctattccatttattctctctgccaggaatattcgcatacaaatgtgagaatgctcttgtcagtctggatttctatcagcttctaattgcttcggtctgacactccatctgtttcttttgtttcctgtgcaccttcctgaggcctgtctccaggtcatcactgtggctttccacagcatgtgtgccactctccactctttccagtggtgctcccacctccctccaattctttccttagcttttccacctccctttccaactcgttagtttcacctcttcttttttttttttttttttttgagacggagtttcactccgtcactcaggctagagtgcaatggcatgaccttggctcactgcaacctccgcctcccgggttcaagcgattctcctgcctcagcctcccgagtagctgggattacaggtgcccgccatcatgcccagctaatttttgtatctttagtagagacagggtttcactatgttggtcaggctggtctcgaactcctgacctcaggtgatccactccccctctcagcctcccaaagtgctgggattacaggcatgagcaccgcacccagtctaaataaatttttaaaagacagggtctcactctgtcatccaggctcgagtgcagcgccgcaatctcggctctctgcaacctcaacctcccaggtttaggtgatcctcccacatcagcctctagctaggtacatgctaccatatccagctaattatatatatatatgtgtgtgtgtgtgtgtgtatatgtatgtatatatgtgtgtgtgtgtatacatatatatatacacacacacacacacacacacatatatatatacatacctttttttttttttttttttgaagagatagggttttgccatgttgcctaggctggtttcaagctcctgtgctcaggcaaacctcctgccttggcctcccaaagtgctggaattacaggtgtgagtcactgtgctggccttaaaatattctacaatactacaatagaaaattgggtaaacggtaggaatagccaattagcaaaagaagaatttaacatacaaaattagtttaaccccagtaacagtcaatgaaatgtatgttaaaataacgaggcgtcagcaatcaagagatggtatgacataaaggttgagagcgaaggctctggagacacactccctggtttcctatccctgggctctcatcacttttcagctgctgaattttaggcaagttaatgaatcttcatagacctcagtttcctccttcatataacagagtacccacttcattggactgctgtgagaattgaatgaatttaatgtgacttgttcagaacaacgcgtattaagcactcagtaaatgttggccgctattattatcatctgttacatttgcatggcataatgaatggtgtttggggggagaatgtgggaaaacacacacattactgataaaaatataaattggtatccctttctatagggaaatttgatattgactcaaacactttcttgtgtatacagtcatgtgtcgcttaatgacggggatatgttctgagaaatgccttgttagatgatttcatcactgtaagaacatcacagagtgtacttctacaaacctagatggtctatcctattacacaatagggtatagcctatagattacagggtatagcctattgctcctaggctacaaactttttaaatgttaattaattaactaattaattattttgagacagggtctcactctctcatccaggctggagtgcagtggcaggatcagggctcactgcagcctcaactcctgggctcaagcaatcctcctgcctcagcctcccaagtagctgggactacaggtgtgcaccacatccagcttacttttttgaatttttagtagagacaggatctcactatgttgcccagcctggtttcaaactcctgagctcaagtgatcctcctgccttggcctcccaaagtgctaggattacagaaatgtgactgtactgaatactgtaggcaactgtcacacaatggtaagtatctgtgtatctaaacagctaaacagaaaaggtaaggtaaaaatacagtactagatatcttttttttgagatggagtctcgctctgatgtgcagtggcaccatctcggctcactgtaacctctgcctcccgggttcaagcgattctcttgcctcagcctcccaagtagctggaattacaggcgctcgctaccacgcctggctaattttcatattcttagtagagacggggtttcaccatcttggccaggctggtctcaaactcctgacctcaggtgatccacccaccttggcctcacaaagtgctgggattacaggcatgagccaccgtgctcttttttttttttctttttttttttgagacagagtctagctctgtcgcccaggctggagtgaggtggtatgttctcagctcactgcaacctctgcctcctgggttcaagcaattctcatgcctcagccccctgagaagctgggactacaggtgcgccaccatgcccagctaatttttgtacgtttagtagagacagggtttcgccatgtttcccaggctggtcttgaactcctgacctcaagtgatctacccacctcggcctcccaaagtgctgggattacaggcgtgagccaccatgccgggtcaaaaaatatacactactagaatcttatgggaccaccgtcatatatgcagtctgtcgctgactaaaacagtttttatgtagtgcctgacagtatatatctctcttttggccaagagattttcagtccttaggaatttatcttaaagaaataatcagacatgaaaattttatctaccagtatgcttgctgcagtgcttccttaaaagtaggactcacaacacatgcacatgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctgagcaaactatcgcaaggacagaaaaccaaacgccgcatgttctcactcataggtgggaattgaacaatatcgcttgggcacaggatagggaacatcacacaccggggcctgtcaaggggtggggggaggggggagggatagcattaggagaaatgcctaatgtaaatgacgagttaatgggtgcagcacaccaaatatggcacacgtatacatatgtaacaaacctgcatgttgtgtacatgtaccctagaacttaaagtatgataaaaaaaaaaataggactcacggcccggtgcggtagctcacacctgtaatcccaacactttgggaggccgaggtgggcggatcacgaagtcaggagatcgagaccatcctgggtaacacagtgaaaccccgtctctactaaaaatacaaaaaattagccgggtgtggtggcgggcgcctgtagtcccagctactcaggaggccgaggcaggagaatcacttgaacccgagaggcggaggttgcagtgagccgagatcgtgccactgcactccagcctgggtgacagagtgagattccatctcaaaaaaaaggaaaaataaaaaaagactcacaattggaaataactgaaatgtctaaggataggagactggttaattattgtacatcgggggaaaatagatattaaaaatgacattttaggagaatatttcctgaccttgttatatgatcacaatatactgttcagtgatatatcaggttataaaaaagcaataagtgtacattatggccccagttttataataaatgtaaaacaaatatagatggaaaaacatcaaaaggtagtggttatagaccattccaattatcctctttatacttgtcagcatttttcaaaaattttaaaaataaacaagtacctaatctcagcactttgagaggccaagatgggaggataacttgaggtcaggagttcaagcctagcctggacaacatggtgaaaccccgtctctactagaaatacaaaaattgtccaggcatggtggcacaggcttgtaattccagctactcgggaggctgaggcaggagaatcgcttgaacccaggaggcagagattgcagtgagccaaggtcacgccactgcactccagcctgggcaacagagagagactccatctcaaaaaacagcaacaacaaaaaagcaagtaccattttaatgaacagagaagtagtatcattttcaaaacaagcattaaaggcccctgaaaaggatatgactttttcacattctcacttcaacccaccagatgttctgcttctttgttggaagcgctttaagtaagctccatgcttaggtatgtgttcgagccactctcatttatttatggttttaaataaattatcaacggaataaagagagtatatacgagaaatatctcaaagacttgtaaattcaacttttgtgtccttgcatttcctatttttttgattatttgttctcctttcttttaagcaccaaattatacccttttaaaaaatagctctttctctttttctgttttctctacatttttcttagtttttatgaaggaagattgttaataactgccagtatctgtcacgacacaatcctttctttcttttcttttttgagatggagtctcccgctgttgcccaggttggaatgcagtggcgcaatctcagctcactgcaacctccacctcctgggttccagtgattctcctgcctcagcctcccgagtagctgggattacaggcacacaccaccacacccagctaatttttgtatttttagtagagatgggatttcaccacgttggccaggctagtctcgaactcctgacctcgaatgatccacccacctcggactcccaaagtggtggagttacaggcatgagccactgcgcctcgccacaatctcttttctttgatgtcagtatctttctgcactatcgcactctaaatacagagggtccctgacgtacgatggtctggctgaatgattttttcgaatttacagtggcagaaagcaatacgcattcagtatgctcctccacttcccatggggtcacatccgcataaacccatcgtaagttgaaaatgtcgtaagttgaactttcaatttataataggtttattgagaggtagccccattgtaagtcaagggccatgtgtagccagttctcctgcgtttcttgggcttcaacttttagtgcatccatcacctgaaattcctctcttcctgcactcatgttttcagtagtctatagaacgcaggcccaacaatatattgatctgtcaatactcagcaaataaagcctgtgctcacaaaattaatctcagcctaagggcagcccttgtaggaattgtgagcacacccaccccacggatgttgaaattatctcccaggacaaatgagactgggcagaatgttccttggccagttttccttggccattccatcagttgcttctagtccctggctgagagttgggcttgctcaagggtgtctgtccaccccagagcctcatgagccacagacataggattgacccaatgtcagcaatttccctttcctgtggggcaggagaatcagggcaccctgagggatggcacgtggaaggcagcgtggaacccgcctgagagcctgtgtcctgactctgcctgggagcgctgcacttcacccttgggagaacgccttctcagtggctgaactctgcattgtggctgtgcaggctggcttcagacactgttttctccagtgaggcctcttacactctgctcagctcagacctgccataaccgcttgtcggattttctctatttaatgatcaatgtcatatatgtactttttttttttttttttttgagacagagtctcactctgttgccaggctggagtgcagtggcgtgatctgggctcactgaaacctccgcgtcccggattcaagcgattcccttgcctcagcctcccaagtagctgggactacaggcgcgtgccaccatgccgggctaattttttttttgtattttagtagggaggggtttcaccatgttggccaggctggtctcgatctcctgaccttgagatctgcctgcctctgcctcctaaagtgctgggattataggcgtgagccaccgcgcccaaccatatatgtacttttctaatagagttttagattgtttgaacttctgatgggtgagaaaaagaataaggctatgatggtattctttcccttagaacccatatagtttccaaaattcatctttcatgtgctctttatttcttttttagaaacctgggtattattttccaagctttgtgctttttgtgaggctatacaggttctatggtgaatcctcctcatgcctgcgacaacctggaggacattacttgtttttagctgctgataagagtttgcaaagaacacacatctttgttgggaaatgctttgatgtgcttctaggcaagatgaagagtcacatggagtgggggtggtaatttgggagaagggccaagtagcaggggattctcgataaatattaaatgaatggaggtaggaaggaggtctctgaaccacactgtgtgtgggtttaagatcttgctgtgggctttgtggtgtaatgcctcaatctatatcccctactgaagtctatatttgcacttgtgcttttgtgcaaatggggacaagcagaacttcaagacaataatgaatatttcagctacgtttttcctccatgaatcgtgcaaagctctctgaattggcactattactctttcttacttctgcaaccccagaactgcttaatgcagttatattttcctttctcttcccagtgacagatgtccccttattttcctgggcggcaaatgccttcttttccttccttcctccttagaaactctcctgagcacaataagctacagagcctggtggtgggccctatggttggctacataccatgccatcccgggggctcccttttggtttcctgctggtacctgccctcgcctgggatgtcctctttgggttcccatctgccgtgctctcacctggaagccagctctgtgggcctgggagttgccacgattcctaccatggaccctccagctggttcccatgcagcctgccctatcgtcgtgtgcacattcacctgctaggcattctcactatgcagtcagtatgggcctggccttttcctcttccttggaaaatccatctcagtgttttctttttttttctttttaggtagagtcttgctctgtcacccaggctggagtgcaatggtgcaatctcagctcactgcaacctccgcctcctgggttcgagtgattctcctgcctcagcctcccaagtagctgcggctacaggcacgtgccaccacgcccggctaagttttctatttttagtacagatggggtttcactatgttggtcaggctggtctcaaactcctgaactcgtgatccacccgccctggcctcccaaagtgctgggattacaggcttgagccactgcgcccggcccatctcagtgttgtcatctggccctggtgtttctgacatggtgtgtgcgagttcagtggattctaaaaactgctcctctcctccttccccagggctgccctctgtcatttcctatccagcctccctctttccttcctcctctctggcagtaacctcgtacccatcccagaaaggccattgcctttccctggtgacttcctctctcttccctcctcaaggtccttgacgaggtcatcgggagtgtccttgacagctcccctttctttccacattcgtatagtctggctgataccaagatgcaccttttctttttttttctttcaagtcttgcatcacatagatttttctgcaaagccacactgtgccctgaaaccagggatgcctagggctgaaaaccatgtgtgagcttcatactcattagggtgactattattaaaaaaacagacatcactagatcatcagggaaatacaaatgaaagctacagcaagatatcacatcaaacctgttaggatggcaattatcaaaaatacacaagatgacaagtgttgctgagtttggagaaaagggaaccgtggtatgccattggtgggaattaaatttagtacagccattttggaaaactgtggatgtttttcaaaaattaaaaatagaactaccataggatccagcaatcccactactaggtatataacccgaggagacgaaatcagtatgtcaaagaaagatctgtgtttctgtgttcattgcagcattagtcaaaatagccaagttatggaatcaacctaagtgtctatcagcgaatgaatggataaagcaaatgtggtatatttacacaatagaatactactgagccctaaaaaagaaggaaatcttattacttgagaaaatatgggtaaccctgaaggatattatattaaatgaaataagccatgcactggacaaatactgcatgatctcacttatatgtggagtgtaaaaaagtcaaatttatagaaatagagagtaaaatggtggctacctgaggctgtggggtggtgagattagagagatgttggtcaaaggacacaaagtttcagggctggctgcggtggcttaggcctgtaatcccagcactttgggaggccaaggcaggcggatcacctgagaccaggagtttgagaccagcctggccaacatggcgaaccccgtctctactaataatacaaaaattagctggacgcggtggtgcacacttgtaatcccagctacttgggaggctgaggcagaagaattgcttgaacccgcgaggcaggggttgcagtgagccgagatcatgccactgcactccagcctgggtgacagagcaagactccatctcaaaaaaaaaaaaaaaaaattcagttagaagaaataaattcgagaggtttattgcacatcatggtgactacaattaataacaatgtattgtatacttgaaaattgctaagagaataggttttaagtgttctcaccacagaaaactaagtatgtgagagaatacatacattaaatggcttgacttagccattccacaatgtatgcctatgtcaaaacttcatgttgtacaccataaatatacaccatccccctcagtactgtcgtcatgatagtgagtgactttaatttttacttgtcaaagtaaatacattaataaaaaaaaaaaagtaaatacattaataaaaaaaaacccagaaaacaagtgctggtcaggatgtggagaaacgggaattcctgtgcactgctggtgatgacgtgacgtgatgaagcccctgtgtaagcagcgtgacagttcctccaaaggctgaacataaggccgggcatggtggctcaggcctgtaatcccagcacttagagaggccgagacaggcagattacctgaggtcaggagttcgagaccagcctggccaacatatagtaaaaccctgtctctactaaaaacaaaaattagctgggtgtagtggctcatgcctgtgatcccagctacttgggaagctgaggcaggaaaaccacttgaactcaggaggcagaggttgcagtgagctgagatcatgccactgcactccagcccaggcaacagagtgagactccatctctcaaaaaaaaaaaggtaaaaaggttgaacatagagttaccctatgatccagcaattccacttgtgggtacccaaaggaaccaaagtaaagactccaacagatacctgcacacccatgttcctaacagcattatttacaatagtccaaaggtggagataacccaggtgtccatcaatggatgaatggataacaaaatgtggtctatccatgcaatggaatacaactcagccctgaaaaggaatgatgttctgatacaggctacaacatagatggatcttaaggacgataagttaagtgaaataagacaggaacaaaaagataaatactgtatgatcccacttatatgagatacctagtgtagtcagattcacagaggaaaaaggtagaacggtggtcaccaggcatgggcagggcgaatggggagttggcactgaatgggtacagagtttctgtgtgggaagatgagaaagttctggaggtggatgctggtgatggttgcacaatattgtgaatgtacctaatactgatgaattgtacatttaaaaatggttaaaatgataaattgtatgttatatatattttaccacaactaaaaaaattaatgttcaagggtgtccaagcaagaaaaaaacaaaaaccacccatgtgtgctcacgcatctttggcacagatgcggttcctaggttcagctctctcctcaggcattgtctcttcaatgacaacattctgtttccaccaactctgtttctgaaccaaatctgacacagctgtcactggcctactccctggaattaccacaggatctgaattagcctctggcaggccccctgaggaatcttgctttcacgtttccattatggtcagcacagcaacatggcggcctatcccgttttttgtttttttttttttttttttcctgagatggggtcttcctctgttgcccaggctgaagtgcagtggcacaatcttggctcactgcaaactccacctcctgggtttaagtgattcttctgccttagcctcccaagtagctgggattacaggcacacgtcaccagacccagctaatttttgtattttttagtagagatgggttttcaccatgttggctaggctagtctcgaactcctgacctcaggtgattcacctgcctcggccttccaaagtgctgggattacaggcgtcagccaccacatctggcctgcctatccctttgattgaatatcacctgagtaactgatatggtttggatctgtgtctctgcccaaatctcacgtcaaattgtaatccccagtgttgaaggtggggcctggtgggaagtgattggacatgggggtggtttctcatgaagggtttaaaaccatctcccttggtactgttgttgtaatagtgagtgagttctcaagagatctggttgtttaaaagtgtgtagcaccttgggaggccgaggcaggcggatcacgaggtcaagagattgagaccatcctcaccaacacggtgaaaccccgtctctactaaaaatacaaaaaattagccgggcgtggtggtgggcgcctgtagtcccagctactcgggaggctgaggcagaagaatggcgtgaacccgggaggcggagcttgcagtgagccgagatcacacctgggcgacagagcgagactccgtctcaaaaaagaaaaaaaaaaaaggtgtgtatcgcctcccccttctctctctttctcctgctatgtaagatgtgcctgcttacccttcaccttctgccatgattttcaatttcctgaggcctccgcaccctccgccctgagaagccaagcagatacaggcatcatgcttgctggaccacctgtggaaccacaggccaattaaatctctttataaatgacccagtcccagggatttctttacagcaatgtgagaatgaactcctacagtaactcatttgtctttgactttcctctttcttttagtgacagtgtgtgtgcctaagtgactcttgaagaagccttcattcttgaagacacccggtcctcacaggggctcctggggcggtgtctgtggcaggtgaagatgctattgcagaatttatcttccttgccagaagagaacgcctgggcaaaggagaactgccttatagcccaaactggggcccactgtcttttcaggtctctggccatggggcttgacagctggattctaacgtctctctccctagtgcctcccacgtttactctccatgttctgttgattttcttggtgtgtttgcctccccgatcgcatctttgctgtctgctccacactgtacccgatttctgcccctccttgcctctcttgattactcagagcttcaactacctcctcacctctgacaactccgtctattgcttacaggttggttcacctcacacacctgtcacctcatggctgtggcttccgcacctgtgtgcatggcgccctcctcccatagctctcttcccagcacaacctgcagctcctcccgctgcccagctgctccacacgagccgtgattagctcacaccggcctttcctcctccactatcagctcagagccagccatagctcacaactctgagaagtcttccctgagccatacggaggagactgtcgccttcacatttctctcccaggacccttcaagtatagattaggtgctcagcaatgcctttcactgcagtcctcatcctttttcctgtctgcacttctggagcacgggatgcctgcagctttcatttgaaacccctttctatgctattgggacccgctgtgtcttagaattgttttctgggttctaaacttgctccctcctctagtctagagaccaaggactgacatgtaatttgcagttggtatcggtatgtatgagatgtagatgctctagtaacatgggtccggtgatactgacttacatcacgctggattccttccttgcttcatataccctcatgtaactttccgtgcatattttctgcctccttggagaggttgtacccccagagctccaggggaaaagaataactgtccacacagaggtgagtattggtgctttctagccatacactagcatgaggggaggggtcagggaggctctgtccatagaaggcttcaggagtcgcccgttgccatggattctgtgttttttgaatcccagatgcccaggtgagacctctgatttgtgttccccaagaccacagacacatggagcttcctggcatcaggttcccgacaccagagttggggttcctttcaactctattacagtcaacgagcgtcatgctcacggactcgttcagagccacatgctttgcctggccttctgctcacctctgagtggcatctggagaagaggtggcttcatcttgctgcagtcctcccagcgtggagagacctgcactcatcagtgaaatgaatacaacgggaggtgtctggaacctttcttcattttcaccaaaggaatatttgacacacccaggcatggttcagagctccaccctcaacaataatcctgtcaaaatatccgatgttgttgaacctcaaaggcactgtatcacagcagaaaagtgattgatctcattgctaaactctctttcttgcttattggcatgacaacggagctaaatagagccgagatgaattatgagtctatttttggagactccttatggaattcatgcacactgtgtattttgcatcctttgaatccttgggcacacttagaactgtgaagcaaacactcatttgtaaatgttacagctgccaaggttggctgcatgctctgctgggtgacgtgttaactctcacaagtctgctttggaagcaggaggaatgttttgagctgagcttcgggcggagggtggggctgacgcatgcatgcttaccttgaccctgtccatacaggcttccatctttagctgctccacagctttcctggcttgggagatgctagtggtgctgttattagacatgccctctttcattctactgcccctagaagtaaccaaagtaaaagggttagaagagctgctcttccaagggtaggggaaccccacctcccaccacctacagcttctctgtccaagccagggagcatctgggagcatggacagcatttggtagaaaaccctcctgggataagagaaaggaatgcctcattcgagtaagaggagcaagacatgatgcttttgtttggaaaaactttctcagtcccggggacagtgagaagagaacagaaggttccagaatgacttttccatcacccccaccactgccaccaccatcaccaccacgaccataagtaatgcttggacattcgtatagtgctttgagtcatcattcactttcacacacgtttgctcattcattgctctagcagcccatacagttggtgggacaatattaatttctattttgcaaaggaagaaagtgcaaaaatcagagaaattaaaccaatagccaaagatcctacagccaacatttgtggatccagaactcaaactcaaagctttgaagcctagccgagtgtctcaaatggcctctcctaacaatctatggctcataacacacatttctaatgaataaaattgctttattaattttaatttgttgtccttccaaaaagtttacagactttgtgttgagagtttgttttcaacaataaacacacgcacaaacacacactctctctctctttcttccctatcccaagcatagatttattttctagagggaggcagaagaaattctccctaaccctacacacattgatgccccgtgactaagaccagtgtagtgctacctgtttcacagaaagcatgtgctacacacatcacaattgcaattgccccgtctaatgagaatctgcttcaaaggaagcctaaaactaaagcctgagagctggggacaggtcactgagagcagaaacacaagtgacactggctcccaaaggtacagatgaggtgggaagaggccctggccaccatctattattcgtctgcttctgtttatattttatttcagttttaggtttttttcccacctcacaactgttggactttattgtattaatttaattgagtatgtaaagcagcaaccatactttcaaagttaaaatgatgcaaattgatattcacacaggtgtcactttcactgcccattccaatccttttctcccctcccacctacctcctatgggcaaccaatcacactggactccagtctattctttcctatgcttcttttttctccttccttccttccctccctccttcccttcctccctccctctggtcttccttccttcccatcacgttggactccagactattctttcctatgcttctttttccttttcctttcctttcctttccttccccttcccttcttccttccttccttctttttgagatagggtctctgtcatccaagctgtaatgcagtggtgcaatcacagctcactgcagcctcaaactcctgggctcaagcgatcctcctgcctcagcctcctgagtagctgagactacaggtgtgtgccgccatgcctggctaattaaaaaatttttttttgctatgtttcccaggctggtcctgtgtttattttcttagaaagtaagcagttacatatatgttttctcatttctccttctttcttacacaaaaagataacgtgtgtgtgcttttgaactttgtttttatatttagcaatacattttagaaagcaccacatattagttcactgatatgcaaaaaagatcatactcattctttcttagaactacatactacagtactccactgtgtggatatactgtatatttttcaatccatatatttacgggcatttacatctatattctcatattattgtgggggtgtgtcttcaaggtacatttctggaattactgggtcaaaggtaaatgcatatttacttttgtgatatattaccaaattctataaggtaacattctgataatttttgcatcaagattcttaagtaattttggaattcagtactattcttaagtaataaattaagtcatttaatgctaccttcatctggtttaaatatcaatgttatacttgcttcatacaaaacatttagaatttttaagaaattttctatttggccagtaggttagtgtatgggacccactctctctgtgggttttaatcacatatgaactaattctctggcccagaaaggcataatggcaactacatttgtccaaaggcagtttttgaaaagtaaaatattctcgttagaagacagatcagccacccaaatcagagtttaatagatgtgtgtccttatcttagtttggaactttaactcaacaacaagggaaggagaatcacgacaagttgggagctttgaaatccaaggaacatccccttcatcccccactcagcagaactgtgcacgcgttcctgcacatgtgttggtgtgtccttgggtgtgtctgtatgtgcccacgtgcctgctcgtgcaggccttgtgccagtctgtgtgtggccatctctccgtgtgtgtgtgtgtgctgatgtgtgtctgcgttgctgtgtgtctacacaaaatgagggaggagacacagtctagttcccaacccttcccagctgatgcaatgaaaaaaggactctgatgtgatttggatgtttgttccctccaaatctcatgacgaaatgcgattcccaatgtgggaggtgggtcctggtgggaggtactggatcacggggccagatcagtcaggaagggctcagcgccaccctttggtgataagtgaaagtcactctgagttcatccaagacctggttgtttaaaagtgtgtgtcgccttcctgctgtctctcttgctcccactcttgctgtgtgatagtatggctcccccttcaccttctgcatgagtggaagcttcctgaggcctcaccaggaacagatgctggctgccatgcttcctgtaccacctgcaggaccataagccaattaaacctctttcctttagaaattacccagtatcaagtattcctttacagcaacacaaaacagcctactacagaccctacagtgactgccttcaaatcttgatcctgctctccccattctagactccatccctctcgccccttgtctttgacttgggcatttaggagttgggggaggttcaggggaggaggaggtagagtttgggatcagcaggggtgaagccaagaggacatggagcagggcaaagggaggaggggagggctctgcactgtgtgtgagggagtctgtggtgagtaggagtgtgtgaaagtgtggggtgggggtgagcgtgtgagagtgtgtgggggtgagtgtgtgtgacagaaagtatgtgtgagggtgtgggtgagtgtgagtgtgtgaggtggggtgtgtgtgatgacagtgtatgtgagtgtgtgtgaaggtgtgggttggggtgtgtgtgagggtgaggggtgtgtgtgtgtgagagtgtgagagcatgtatgagggtcaggggtggggtgtgtgtgagtgtgtgtgtgagcacgtgtgtgagcatgtatgagggtgaggggtgggggtgtgtgtgtgagggtgggtgagcgtgtgtgagggtacagggtggggggtgagtgtgagagtgtggatggggggtgggggtgtgtgaatgtgaggtgggtgtgttgtgggtgtgtgtcagggtgtgggttggggttgtgaatgtgggagggtgtggggtggcggtgagtgtgagtgtgggagggcatggggtggggtgtgtgaatgtggggtggagtgtgagtgtgggagggtgttgggtgtgtgtgtgactgtggggtatgtgtgcgagtgttgggtgtctgtgtgtgagggtgtgtgtgggtgtgggtcagggttcagggtgggggtgagggtgagtgtgggagagtgtggggtgggggtgtgtgtgtgtgtgaaggtgagagtgtgaatacaggcacgtctcagagcatgcggggtgaacgtgtgtgtaagtgtatggagtgtgtgagagggtgtggggggtgtgtttgtgtctggagtgtgagtgtgtgggtataagtgtgagtccttgaggatgtgtgcacatgtgcacaggtgggtcatgtggcggggagggaacagctaacgttaccggggaaagcagcagagccgactctcagtcccgtcaggcccctgcagctgcgcccacctctctccctcccaggcgctgttcagacggccctgatccctcagcccttcctcattcttccgctgttcaaaagaagggctcgttttccacatgccctaccctctccgcagaggagagttctggctggaggcttcctgtgggaaggtcccaccagcgcactgtgctttccttgttgtgcgctggagataaaataagcgggtgggtgaccctctgggggttccatccctccatggcctccctctcaggccctccatgtgcgtccactctccagcccatgtctgccacccacagccgaggcccctggacctggcccccagcgggggctgtgctctccgaccccagcttctccctcagccccttctctgctgcttcctcctcccctggctccatacttagcctcaacagcatgacccaactaccaccactgtctcccaagagccgtctgcttctctggccctttcctctgtccctaaaacctgcttcggtatggacccaactcctcccctctccacactcacgaaggggctgctcagcgctgctggagagaccccccccactaaactctgcccatcagacatccacaatccagcctctgcgaggccctcagagctacctggcaataggactccttgccccaaatcatctccccctcccttcatcctcttcttccagtcttcatcacttcctcatcacctctgacctttcctcctcagcagaggacctcagcccctctgtctacacagaatggccattagcagagaaccctccttaatgttccccaccccacctactccactccacacccacatccatccttgcctccactcagggcagcagctcttcctccacagcagagcctgtaggacaccacccacagctgctcccgacttgctgccctgccggcagggccctccttcctccccaggggctgacaatggcagactcactttcttgcctcccttgctgtaaggccagagcacgcgtgtcaggaacatggctgtgctttggtcaaggataggctgaggtaaacatccagagtgactcagcaagtttagagcgcaggcgtataactccacttgtcatcacagccatatagccataacatcggaaggctcatcatttggctctaagccactgttgtttgtaaaagctattattgccctgctgacactgtacaggcatgctggcgcccagagaaagagccaaagctgtccattttgcaggtagacagggggagccagggcacagcacagttcagctcgtgcccagagagagaaagagttaagctgctgaccccgaaggcaggggagagtcggccatgcagctatgtgtgggagctggctgctgagaggagccacaaagccagagcagacagctgagtcaaggcggacagtgtgagagagctggtatgagtcagctgctgagagacctgttgagtaaaactacatttcacctgcttatggccccacgagtgttccttcagctacctgcccatccgcccactcccctcgaacctcagcatgggctggaacctgaccccaagcagggcatttggtatagttgtgaacctgacaacgtgaccttgtcctcctcaatgggacatcaggggaaatctgcagggactcatagggagggttttcctccccgacggagggacaaggggagaaagctctgtctttggccaccttgagttgtgtttgcagctgccagagccataaaaccactggggaatcaaccaaggacacggtcactagtctagtggagaaaatgacctggatccttgagctgggtgggtccttggaagtctattcctgatccttgaaatgagataatgtactcctcatggttcaggccatatttgttgggtcatctgtcacttgcagctgaaggcatcttctcagccaaggctaacacttcacaggtcagtagaccgctcccctccccaagggatctgccctacactcacccctccatcctgtaatgtccacgtctctggcgcttttcctcctcagaatatgcaaatatatttatgcaatctgcacctgaccatcttaaaacaagcaacaacatcaacagtcttccctccctgcaatcttctgcattcttgcttaagaaggtggagaggctgggtgtggtggctcatgcctgtaattccagcactttgggaggccgaggtgggtggatcacctgaggttaggagtttgagaccagcctgaccaatatggtgaaatcccctctttactaaaaatacaaaaattagccaggcatggtggtgggtgcctgtagtcccagctacttgggaggctgagacaggagaattgcttgaacctggaaggcagagattgcagtgagccgagattgcgccactgcactccagcctgggtgacagagtgagactgtctggaaaaaaaaagaaggtggagaggtaaccacagattcccctgagaggcccctcagtaactaaaggaagagattctaatgtaaggatgaaaagccgtctttcgggagcactgggtaaacaggcctgctccacggtctctgctctgctgccctcggctcaccctgattctgtgtctaggacagtcacccttgttgcccagagtgatccttaagcgatttcatgtgtgcgtgtttgtgttttctctctccaaggggctgctctggcttctcccagcactgtggccctgcacacctggacgtccgtattttacaatctcccaggctgattctggcccgtaccaaaggagagcaccactgctggctgtgagccacttctacttcgtgattccttagtgtccaaattaccttgcatgggacgcataggatgtctcatgtaccttaggggctgtctcaactagtcctttttgaattttaacgtgcatatgaatcacctgaggattttaaaatgcagattttgatcgagtggctctggggtaggggccgagatcctgcgcttctaacgagcttcgtgaggctgctggtccacggaccacactttgagtagcaaggctctgaatcactgactgttggtattgcaggggaacatggaggtccggttccaatcctcttatttttcagataaggaaatatattcaaggaggttaggtaacataatttcccagcgctcctcagcaggagtggaaggaagcactgctccgccactgctcctggctcattacccaccttggcctagtggcgcttaggatttcatcccccacacttggtctgtcctgctctcctggaacagactcatcccctgggtgatcctaaccttgcttaacctgggagtgaggtgtcaggagggagccccttccctgaggtgggcaaaaaaagcaggaaatccctggtgggggagaaggtaatggcttttgccaatggtgctgaagacaaccacatgctttgaagatagagccctataagaaggtttcggaggtcctgcttcccctacctggccaggtaccctttaggctccacctgaataacgcccctgcctttctgagactgtctggatgctatatgtacttccatggggactcaggtatgcctccctgcacagacattcatgcgtctgcacatcccacctggacccaagaagaaaaatggaagtaggaacagagaggagctgcaacaaatctccacacgcacactggctaccggcaacactgactgggctctcggctttccagaagatgaggcaagggggaaaagggaccatttgcttaggggtggcacctggggccacgtgctcacacagctctttcttcccaggtatacaggaatgtgctcatgcacataggtcgcaccgggggtttcttgagatgcagcagagaacccgttgtacgggtctgtgggacccccagcagggaaataaaggaaaatcttgagttccttcaagggaaattccaagctagcaccaagttagccctgagaagtaaataagtgacttgataagcaagaaggtaatagtagcttaaaacaatagccaaggaagctagaattacgagatgtttggtttccctatagaaactaaagataacatcttaacatatgtctctgagttgtttttcagaaacccggccccctacggaatgaatcagctggcacagagacctcagatgagggggaactgaggactcaactctgactgctgcttttggttctaaatttcttcctgggccgggtacagtgactcacacttgtaatcccagcactttgggaggccgaggcaggtggatcacttgagatcaggagttcgaggccagcctggccaacatggtgaaaccccgtctttactaaaaatacaaaaaagattagccaggcatggtggcacgtgcctgtaatcccagctactcaggaagctgaggcaggagaattgcttgaacctgtgaggcacaggttgcagtgagccaagatcacaccactgcactccagcctgggtgacagaatgagactcttatctctaaataaataaataaatttcttcctgagggtcctggagggagtcctgcccacaagccagagctaacattttttttgccgaccccaacattttaaacaaagcttcttttccttaagtgattgcaaatcagaagatctttaaatccatccacgacctgtaacccctggcttgaagatagccgcccttttcggtcaaaaccactgtgcaaccgccatgtgtcgattttacaatcttacctgtaacttctttcctgaaatgtacctccgactttaaaaacccttacctgcaagctactggtcaggatttgagcatgagccgccgggtcctccttgcttggtgcccagcaattaaacaccctcctttcttccactgcaacacctcggtgtggatatctggtcttaccacgctgggcaagcagaccccggtttgctctgtaacattttttttttttttttttgagatggagtcttgctcttttacccaggcttggagtgcagtggtgcaatctctgctcactgcaacatccacctcccaggttcaagcaattcttctgcctcagcctcctgagtagttgggattacaggtgcgtaccactatgcccagctaatttttgtatttttagtagagatggggtttcaccatgttggccaggctgatcttgaactcctgacctcaggtcatccacccgtcttggcctcccaaattgctggaattcaggcatgagtgcctgcatccgaccatgctctgtaaaattctgatgggctgcatcttgcagcacacaactcagtaaatacaaagttggggctgggagaccaatgcaaggcggttccatccccagtgcttctgacctgacctgactcacggcacagtacttagaatttctggaagccaaatgtcattgtgcctttgcagccatcctccccaactacgacttctgtccatgagcacttgacaagtatctgtaggcagaatactacagccggccttccggacaatgcccaaaagacagctgggtccggaattggtgggttcttggtctcaccaacttcaagaatgaagctgcggacccgcgccgtgagtgttacaattctcaattcttaaaggcggcgtgtccggagtttgctactgctgatgttcggatatgtttggagtttcttacttctggtgggttcatggtctcgctggctcaggagtgaagctgcagagcttcacggtgagtgttacagctcttaaggcggcgcgtctggagttgttccttcctcccagtgggtttgtggtctcgctggcttcaggagtgaagccgcagaccttcgtggtgagtgttacagctcataaaggcagtgggggcccagagtgagcagcagcagaatttgttgcaaagagcaaaagaacaaagcctgcacagcgtgcatggggacccaagcagattaccccagctggcgcgggcagcctgcttttattctctaatctggccccacctacatcctgctgaatggtccattttacagagagctgattggtctgttttacagagagctgattggtccgttttgacagggtgctgattggtgcgtttacaatccctgagctagacacaaaagttctccacgtccccactagattagctagatacagagtgtccacacaaaggttctccaagtccccaccagcgtagctagatacagagtgtcgattgatgcattcacaaaccctgcaaaccctgagctagacacagggtgctgattggtgtgcttacaaaccttgagctagatacagagtgccgattggtgtatttacaatcccttagctagacataaagtttctccaagtccccaccagactcaggagcccagctggcttcacctagtggatcccatctggggccacaggtggagctgcctgccagtcccatgccatgcgcccacactcctcagcccttgggtggtccatgggactgggtgccatggagcagggggcggtgattgtccaggaggctcaggccgtgcaggagcccatggtggtggggaggctcaggcatggtgggctgcaggtcccgagccctgccccgcagggaggcagctaaggcctggtgagaagttgagcacagcagctgctggcccaggtgctaagcccctcactgcccggggcttgcgggccggccgctcccagtgcggggccgctaaacccacgcccacccagaactcacgctggtccgcaagcaccgtgcgcagccccagttcccgcccgtgcctctccctccacacctccctgcaagctgagggagccagctcccgccttggccagcccaggaaggggctcccacagtgcagcagagggctgaagggctcctcaagtgctgccaaagtgggagcccaggcagaggaggcgccgagagcgagcaagggctgtgagggttgccagcacgctgtcacctctcacagctatccctgagcctgaagggacccagcagcttaaactgcgagtggggaggaagtgagtggtggacctcctttcatccttgctgaacaaggaagctcactgcaatagcatctcttttcccacagggaagcacacagcacggttccccagccaaggcccagcagccctcggggatggctcagttctcctcccctgctcccccaacaggtgcacatccattcacataggggataacaggaggtggcaaaaggtttctaagggccccgtgtctgccgtggagggtgggagaaggggacaggacagtgatgattgctagaagaaagtgatgctgtgaggacctggccaccatcaaggatcctgagaactgagtctcaccccagcccacacacatgctcctggcgaagacacctgctgtcctcctgcccctacacagggtaagtcactctccttacctgctgagaggcagccgtgtgacaggcctgggcaagggacagaggctggcggtggcagcagctgtcagtcgtcagatgagaggtgaattcagagcttctgctttgaggtcacctgaaagcacaaccagagacatgtctagaggtgtggggactccctggcattgctcccagagtccccatccaccctgtcccatggttcccctctcctcaaactcagcagccttccccaaaagcctggggactccatatcagaccttggggagatggggagctcgaggcagacagagaaccctcagatctgacccagagcagactggaaacacaacttcagggccacaggccaccccgggcctcaccagactgctcccctggaccctgcaaaccttcatgcccagtcgctctgccccccaacacaaggagccccagctccagccaaacctatgccaaatggaaacaggtcacgtgttttcttcttataaaaatatacacttggggccgggcgcggtggctcatgcctgtaatcccagcactttgggaggccgaggcgggcggatcacgaggtcaggagatcgagaccatcttggctaactgggtgaaaccccgtctccactaaaaatacaaaaaattagccaggcgtgatggtgggcgcctgtagtcccagctacctgggaggctgaggcaggagaatagtgtgaacccgggaggcggagcttgcggtgagccaagatcgctccactgcactccagcctgggtgacagagcgagactctgtctcaaaaacaaaaacaaaacaaaaacaaacaaacaaaatacacacacacacacacacacacacacacacacacacacacacacctggccgggcgcaggggcttatgcctgtaatcccagcattttgggaggccgaggtgggcagatcaactgaggtgggaagttcgagaccagcctgacaaatatggagaaaccctgtctctacaaaaaatacaaaattagccaggcgtggtggcacatgcctgtaatcctagctagttgggaagctgaggtgggagaatcatttgaacccgacaggcagaggttgcggtgagccaagatcatgcctgggcaacaagagcaaaaaacaaaacaaaacaaaaaaacacctattatcaaaaaatgtgcagataaagataattacaacaaagaaaataaagaccagtgataatgccttttcccagagataactatggttagcctgttgatgtataatatacttacatgcattagaaatttgatttcaaccaaaggacatttagcatagaagagatcagacgactcgaaagctctttttttttaatatttattttttgagatagggtctcgcttcgttgcccaggctggagtgcagtggaaaaatcacggctcactgtaggcttgaactgggctcaaacgagcctgccacctgagcctcctgtgtagctgggactacaggcgtccactaccatgcctggctaatttttactttttttttttttattttgtagagacggagtttcactatgttgcccaggctggtcttgaactcctaggctcaagggatcctcccacctacggcctcccaaagtgctgggattacagccatgagccactgtgcctggcctttgaaaggtttcttacagcccattcaagactcatagccctgttcgccttccctttgcagccatcctccgtaactgtgacttctccaggacagtctctccaggatggctgactctggggtaatgagttcattccccaagggttttccgaatgctctgccctacggcatccatctccgaggcatcctaatgaacttggagcaaagctaaaagcccgacaagaataagctgacagacctgtttgctcccctggctaaaatggaatccaaattcattttggcctcaacttcaggggagatggtttgaagttgtgcttggtgcatttttctcagcctgtgctatggtcagaatgtttatgtcccccctaccccccccaaattcctatattgaaatccaaagccccaaggtgatgctgttaggaggtgggacctctgagaggtggttaagtcatgaggatggagctcttatgaatgggactcatgatcttgtaaagagctctgacagagatccaggaatgctttatgttttagtttgtttttttttttaacttgtttgctgtgtgtgtgtgtgtgtgtgtgtgtgtgtgtgtgtgtgtgtatttttttttttttcagatggagtctcactctgtagcccaggctggagtgcaatggtgcgatctcagctcactgcaaactctacctcccagattcaagtgattctcctgcctcagcctcccaagtaggtgggattacaggtgcccaccaccacacctggctaattttttttctatttttgtagagacagggtttcaccatgttggccaggctaatcttgaactcctgacctcaggtgatccactcacctcccaaagtgctgggattacaggggtgaaccactgcacccggagttggttttgtattttaatataacagtgcttcttctacttttccaccacattctggggaaaacagaaccactgaggcaactggcttccctgactctggctacccaagaccccacccagagggctgaggtgctggatcaaggctgtacctgtaggttgcacactacactccccagcccactgtggggaagctgttctctaccatcggttccccaaatttggttgggatcagaatcctctgggaatgtacagagactaaggccctgctctacccacctccatgaccttagagttctgtcttagctctcttggagattatgataaaaccactgctctataggcaaccagagcttctcagactttgctgtacatctgaaccactagggggacttttaaggatcccgattccagctgggtgcagtgactcacgtctgtaatcccagtgctttgggaatctgcagcggaggattgtttgagcccaggagttcaagaccagcctgggcagcacagtaagaccccatctctacaaaaaatttaaaaattatctgggtgtggtggcacacgcctgtgatcccagctattcaggaggctgaggcaggaggatcgcctgagcctggaattttgaggctgcagtgagctgtaatcatgctactgcactccagcctgggcaacagagaccctttctcaaaaaaccccaaaaatataaaattaaaaaaataaagatcttgatgcccaagtcaaaccccaggccctttaagccacaatctctgggggaggactgaggcatcagtggaagttgaagcttcccaggtgatttttttttttttgagacaggctcactctgttgcccaggctggagtgcagtggtgtgatctcggctcactgcaacctccgactcctaggttcaagtgactctcctgcctcagcctcccaagtacctgggattacaggtgcatgccaccatgcctagcttaatttttgtatttttagtagagatggggtttcaccatgttggtcaggctggtcttgaacccctgacctcaagtgatccgcctgccttggcctcccaaagtgctgggattacaggcatgagccaccacacccggccttcccaggtgcttttaatgtgcagccgcgtttgagacacactgctcaagtctgcatctagctggagcatcccacactttggtgtgtatgtcatgaaacccgtatctcaggctctcactcaacaggactggctgggacctcggggaggctgcatgctgctactcacagcctggtgggagacatcagcttcagtatcccctggagctcgttagcaatgcagaatctcaggtcctacccaaacctacgaagtcaaatctgcgggtttttttgttgtcgttgtttgttttttggtttgttttttttttttttgagacagagtctcgctttgttgcctaggctggagtgcagtgacgcgatcttggttcactgcaaccgccgcctcccgggttcaagcgagtctcctgcctcagcctcccgagtagctgggattacaggcgcgagccaacacgcctggctaatttttgcatttttagtagagacggggtttcaccatgttggccaggctgataacaaactctgacctcaagtgatccgcccaccttggcctcccaaagtgctggggttacatgtgtgaggcattgcacccagccgaatctgcgttttaacccaggtgattcaggtttacgttagagtttgaaaagttctgagctagaccagcagggcccagtcctgccttatgcagggtccaagatgaagagcctggctgaagacacgtgggtcagtcataacagtggtggacagcagaggtgctgttctcctgacccttaatgttattcacagccccatcagctttttagattcctcttttagataacttactaactctagaagctctttgagaggccacacatcagaaaagacactatcaatttctccttgtcctcctggcatttgcatagcatcttccatccaacgcttgaaatgtatttcagatgtcaacccaccagcctaccccaggaagtgattttagacaccttccctgtatcattgctatttctcaaaataacacagattgttggagctgatgggaatttagctcttgactggattcctttatctggttgcggaagaaagctttttttttttttttttttttttttttttagacaggcagagtctcactctgtcgcccaggctggagtacagtggcacgatcttggcacaccacaacctccacctcctgggttcaagaaattgtcctgcctcagtcactcgagtagctgggattacaggcatgtgccaccatgcccagctaatttttatatttttagtagatatggagtttcaacatattggccaggctggtcttgaacccctgacctcaagtgatctgcccaccttggcctcccaaagcgttgggattacaggcgtgagccatggcgcctggcttttgtgtgtgtgtgtgtgtgtgtgtatatgtgtgtgtgtgtaagagagagggtcttgctctgtcacccaggccggagtgcagtggtgcaatcatagctcactgcagccttaatctcctgggctcaagtgatcctccaacctcagcgtctggagtagttaggactacacccagctaatttttaaactttttgtacagacaggatctcactgtattgcccaggccggttttgaactcctggctcaaaggatcctcccaccttggcatcccaaagcattgggattacaggcatgagccaccactcctggctgaaagctgctttttaatagcactaaattttaccatgatgttttcaaaagcttttcttccctctcaaaagaagaaaatatattcatctttgaaaaaattgctgtgtttcattgtgaggtagtgggaaggcccactggctggccatgagctaactgggagcccctcaagggcagaggccttgttttttttagcttctgtgcccccattgccaagatagggcgggcacgccgtagccagtccctatgaacgtgactctggtgtgcatgaaagaataaactgaggcttcaacagagactttaattccccatggctgctgctgtttcagttcttaaatggagctaaattaactctgggttgtgaagggtaatgacccagagtcatgcagatgtactgatggctccaacaacttccttactttgagaaacagtgatgatacagggaaggtgtctaaaaccccttgttagggtatgggataggctggtgggctgacatctgaaatacattccaagcaatggatgaaagatgtggctactagaattaattaaatcatctaaaagaggagccccctagtggtgctcggctttgaggcacaggtgtgaggtctctgctctcacagagcttactgcctggtgaggggcgccatggactgctggaatcaccatgctgatccatgaatattcttatgagggaggcgcccggctctcagtgtataaccaaagaacttgacctggactttagcatctacattgctttctatgatagattctgaagccgtaagatggaatgagacttgcccgccctcaaagagctcaggtgctgagggagagatgtataaataagcaatgatcatattgtcatgggtgtatgtgggctggctgtccacagaacccatgctccccttcctctcacaggaatgtcatggtgacagggcaggtggcccctggatagatattccccagggtcgcttgcagctacgtgtggctttgtgactcacgtcttgccaatggagatgccgacgatgaatgagtggaaatgatgggtgccgcttccaggcctgggctttcagatatcatttggggacctctgagctctttcccatcacacgtggatgtgtctacagcttaagttcaacaagggcaggcgaggacagtggcctgagtggtgcctccaggtgtggtccctggaccggaggcatcaatgtcccctgggaacgtgtcagaaatgcaaatgcttgggcccactcagacctaccaaaatagaagctctggggccaggcacagtggctcacgcctgtaatcccagcactttgggaggccgaggcgggtggatcacctgaggtcagaagtttgagaccagcctggccaacatagtgaaaccccgtctctactaaaaatacaaaaattagccaggcatggtggcaggtgcctataattccagctactgaagaggctgaggcaggagaatcacttgaacccaggaggcggaggttgcagtgagctgagatcgcgccattgcactccagcctggtccacagagcgagacccgatctcaacaacaacaacaaaaaagaagctctgggcgtgggaaagtgcttaacaaggcctccaggtggttctgatgctcaagacaatctgagaagcacagtcctgggggacgagagagaaacaaaacggaaagagcccacgtccccaaattccccctggagctgagcggccccgttagcctggcttcttacttctgggctcatatgagaaagtgaaatacatttccacactctttaagtcaccgtgtttctgcgtctcttggtcacagcagctttgcatctcactaaccgatacagtatttcaacagaggttagtatactggatggctgccttgaaaatgcttttaaacctgagacagaagtactcatttaagagcttgtatttgggaaactcaatacaatgaggcactcaggtctaacaaggattccacctagtgaaactgtgtttatttctagggtctaacattttaccctaaaattctgttagatgctaggcccaccagatagcactgcttttgcaccaacattcaggctgggttctcctagcgttcatcgtgagcattaagattcccccctttcagctgtaagaaaaattggctttgaattgtcacaagaatttcactaactgagttgacatcttggcattccctcaagaatagaggtcacgttcgcttccacacagggatctaaaagggaggggagggccgggtgcggttgctcacacctgtaatcccagcactttgggaggtgggcaaatcagttgaagtcaggagttccagatcagcctggccaacatagtgaaaccctgtctttactaaaaatacaaaaattagccaggtgtggtggcaggtgcctgaagtcccagctacttgggaggctaaggcaggagaatcgcatgagtctgggaggtggaggttgcagtgagcagagatcgcgccacttgcactccagcctggacaacagagcaagactctatctcaataatgataataataattaataataataataataataataataataaaaggcaggggaagtcctaattcacctggatgtcataatcgctgtggcagcaaagggcacagcctttctatctgtacacgtggatgtgtaaggtggcattttagcaccacatgatcaattctgctgtttctcagtcatcctaggctggagctgaatgtcctgacccctgaagggagtgcagggaacgaggtgccctcccacccagacacccagggctctacgtttgcagtaggaacaccgtccccctcgcagggggatgactcttccccactccgacttcaaccactttgcaaattaagtactgtgataggcaagcttgatacattttacagtatgggtctcaattactcaacttacatcttgagtgcccgatagcatccagctggtctaataacacctaatcacacagatgctaaacaagtccagggattcgaagctttgggcagggcatgggttgtaatggacttgagagacaaccacagtttcttaggaagagcacgcggggtccgaacgacgctggggcctgctggtcacctgtcaccttatctggtccttattaaggtcaagaaaattagagaaggttggcagaccagcggttatacttaagaacatttgacaaattagtgcagaataaacaacagaaagagaaactagatccaccttccgtgggacccttcacgctatccactccctcacctagctggccacccagacactccctgaccattgcttcggccttgcaggtagaaatcaaaactcttaatcaacaggagaagatgttagaagtttactcgtggcctgaggctcttacatcagcccttactgactgtgatgttaattctttctgactgctgggttattcaagttactcaaactggaccacggtgttgaccggcacgtatggaggaacacaaacctgtgtctggtgtgtttgtacagtctataaaccttacagtctagaatgaattcattgtcattcgagtctatcgcagctctactgaagtgggcagatcaccacacgggggacgaaaaggtagttgagcgatggcgtggctgggccacgtctcagcttcctagagctgtgggaacaaattactacaaaccgtgtggttctaagcaacaaaaatttattctctcacagctccggaggctggaagtccaaaatcaaggtgttggcagggtcacgctccctctgaaggccccaggagaaaatccttcttcctcatcttttcctatcatctggtgacctctgataacacttgacattcaatccttgatttgtagacatcactccaatctctgcccccatcttcacataacccacttctctgtgtctcaccgtgtcatcttcgctccttataaagataccagccattggtcttaggtcccactttaatccagtatgacctcaacttaatcatatttgcaaagacccactttccaaataaagtcatattctgaagttctggatatatatgaattctgggggtaaactctgaactcagtatagtcaggaacccagaaatgtggccacaagtctgtgctcactactacaaagaatcagattttgttgttgttgttctttgtaatacctacaagaaacgcctctctgacaattgtatggcgtttcatggctgtgggagaggaatgtatctcagggtgatgggagcatgaactgagaagcagaatttataacctatactcacctcaatttttttcacttgtaaaatgagaaaattgagatccggccagctaagtcatttgtccaaagccattaaatagctaataagcagcaaaaataaggtgagaaccccatatcattcattcattcattaaacacatactatgtcaggcatctcactgaagaaatgaggaagtgggtggaggtggaatatgattcctgccttttttttttttttaaatggagtctcactgtgttgcccaggctggagtgcagcggcacgatcccggctcactacaacctccgcctcccaggttcaagcgattctcttgccttagcctcccaagtagctaggattacaggcatgcgccaccacgcccagctaatatttgtatttttagtcgagatggctaggctggtctcgaactctggacctcaggtggtccgcccgccttggcctcccaaagtgctgagattacaggtgtgagccaccgtgcctggcccgtgattcctgccttctatttatgtggagacaaaactaacagcagcaaactcaacaatcaaatcaaggtgctaccacagaggtcagtaaagggtagaggggccaagaaggagatgatcgattcaggtaaggagaaggttaggaagggctttatactcaatttgagcctaggaagatgaatgggacccactaggcactgtgatcagagagggggagttccaggcagaagtcccatgcaagtgtggtgttgcagcatgggtaaagacggagcaactgagaaccagcctggcactttcaggaaaccctgggtggtcccttattcctgaagcccaggaggtcagggagcagaccaggaagggccttgagtgccacactaagagtgtgggactggtatcatgtaggcaggtgtcatcaaatgaagggttatttaacagagaagtaaaaagattgctgttacattttatttttttgattgagagtgtgggggggtgggtctcactgtgttgcccaggctggtcttgcactcttgggcttaagtgatcctctggcctcagcctcccaagtagctgggattataggcgtaccaccatgctctgctgttacattctagaaaggtcacttcaacctagtgtggagaatggatcagaggtgaacaagataaacaagcagaccgaggtgggcggatcatgaagtcaggagttcgagaccagcctggcctgaacatagtgaaaccccatctctattaaaaaatacaaaaaattagccaggcatggtggcatgcacctgtaaccccagctactcgggaggctgaggaaggagaatcgcttgaacccaggaggcagaggttgcagtgagctgagatcgtgccactgaacttcagcctgggcgacagagcaagactccgtcttaaaaaaaagaaaaatcaaacagaccaatgaggaaaccatgggagtctagatactggctctggtagggagacggggtggagagccaggtggtgagggtggaagagccaggggatgtggttaggatctggatgctggggaggggggaaaggaaggcatatctgggctgaccaccagggagatggtgctgtgctgttccgcacgcttaggaaaagagcaagtggaatggggtgcagagttcacatagggccaggctgaacttaggaggcctttgggaaactgagaagcacatggccagcagacaggaggactgatagagatggaattcacagggagtttgggctgaagacggagctgagcaactcatgacttgtaggggcaggggaagtcctggctgtgggaggctcatgggccagggggagcatgggtcagaaggctgggctgcgtgcagagcctttggcccaaagcagcatgggggggcgagcagaggaaggaagccgcatgctcacttctccagtagctagcttccttccttccttccctccctccctccttcctttctttccttttttttttttttttttttgagacagagtctcacccaggctggagtgcagtcgtgtgatctcagctcactgcaacctccgccttctgggttgaagcaattctcctgcctcagcctcatgagtagctgggattacaggtgcgcaccaccacacccagctaatttttttttatttttatttttagtagaaatggggtttcactatgttggccaggctggtcttgaactcctgacctcaaatgatccccccgccttggcctcccacagtgctgggatgacaggtatgaaccatcgcacccagccctgaaggtttctttctatgttcttcaatctgtacttttcagatttgtggaggtaaaagattacttagtgccaataaaactaattattctttccagaccaaatattgaaatggtgctaaatggagaagtgacagatgagctatggtgtcaccaccaacatcagattacacagcacggatggacagtgtgttgttcaatgaggttgctggccatcgccactgggtgcaccgtggggcctactctcgggaggcagccgcctacagcggaaagcatgcagacaagtggttctgtgaattatctgaagcaaatgcattgtacttcacagactctgtagtagaaaaccaccagtgtgaatttagtgggtcacgcgctttgatcagggagaatgagttcgcagcagttcatccatccacgccgcccagcctgactccctttcatgccatcccatcggcacggcttttcagtattcttgctagggttagggtgcagcctcctacttcagagcaaagccacaagagcagaagtcatgaggccaccctccctgcctctctccgggagggtgtctcctgcccagcacagggcccagccccctcccctcactttagtccattctgatgtgggactttgaggctgtccaagaaagatgaggtgactccatcctctgggaccagctacaggaaatgctgtttctattttttttttttttttttgagatggaatctcgctctgtcacccaggctggagtgcggtggcgtgatcttggctcactgcaacctctgcctcccaggctcaggccattctccttcctgagcctcctgagttgctgggactacaggcgcacgccaccatgcccagctaatttttgtatttttagtaaagacacggtttgaccttgttggccaggatggtctcgaactcctgacctcatgatccacccacctcggcctcccaaagtgctgggattacaggtgtgagccactgcacctggccaggaaatgctgtttctaaaggctgctgccagctgctgccaactatgttttatcacttaccatttcctttttaaaaaaataccaaattcacattgaaatgcttgaattaaaaaagtattgaggttcaattcacttacaataaaattaatcattttaaaatgagcaactcagtgacgtttagtacatccacaatgttgtgcaaccaccaacactatttagttccaaagcacgtccacaccttcagaataaaacctcattccattaagcagttctccattaagcagttctcttcacttcccgctcctcccagatcctggcaaccaacagtctgctttctgtctctacagatttacccattctggacatttcacataaataaaatcacaaaatatgcagtcttttgtgactggattcttcctttgttttcttttttacttagttttttattttttattttttttttttttgagacggagtctcactctgtcacccaggctgaagtgcagtggtgcaatctcggctcactgcaacctccgcctcccgagttgaagtaatcctcctgcctcagcctcctgagtagctgggattacaggtgcccaccatcacgcccagctaatttttgtgtttttagtagagacggggttttgccatgttggccaggctgatctggagctcctgagctgaggtgatccacccgcctcggcctcctaaagtgctgggattacaggtatgagccactgtgtctggctcctcaatttttttttgttgttgttgttaaatagagacaggggtctcacattgctgtctaggcttgtctcaaacacctggctccaagcgatcttcttaccttggcctcccaaagtgctgggattgtaggcatgagccaccgcacctggccagcttttttcacttagtgtaatgttttcaggattcatgcatgttgtagcatgtatcagtatttcattcccttttatggctgaagagtattccatgatgcaggtgcaccacatttagtttatcggcccatctgctgatagacatttgggctgtttccatcttttggctattgtgaataatgctgccacgaacatgtatttgagtacctattttgaaccattttacattctcatcagcaatagctccaatttcttcacatccttgccaacatatgttattttccactttttgggttatagccatcctcgtgggtgtgaagtggtaccctctcttggttgtgattcgcatttgcctaatgactaatgatgtggagcatcttttcatatgcttgttggcatcatttactttaaaaaaaaagtcttaacattaaatattttgaattttgtaacaattcaagttttcagaaaggttgcaagtatagcataaagaaaagtttcctggccgggcgcagtggctcacacctgtaatcctagcactttgagaggccaaggcaggcagatcacttgagctcaggagttcgagactagcctggacaacatggtgaaaccccatctctacaaaaaaaattagccgggtgtggtggcacacacttgtagtcccagctactcgggaggctgaggctacagtgagctgagatcacgtcattgcacaccagcctgaatgacagagcgagaccctgtctcaaaaaaagaaaagaaaaaaaaagtttcttgaaccacttgaatgggagatgtcaacctaactgcctgtcagccctgaatacttcttatttcctacacagaaagacatgatagagccatcaaagttaggaaactattattgatacgttaccatcatctaatcctctaacgctattcagatttcatcaaatgcaccagtaatgccctgcacggtagtaaattcagctgagaatcacacgccacatggagttcttatgcctctttaacccctcagcccttccttgactttgacgacccacagcactttccaagatagcggccgttattttgtagaacacccctcaattcgggcttcttttctgtctcctcataagatgcaggtgttatcctttgccaggaacatcacagaagacaaactgcattcttctcattgcatcctatccagtagcccaagatgtcaccttgtcccattaatgatgttcgttgtcatcacgtgattaaggtggtgtctgccaagtttcttcactgtagttactttttatttttgtaatgaataagaatttgtggaaagataccttgaaactgtctaaacttgttccttatcaaactttcaatatattcaattattggctgctattaggaggcactcagggttttctgttttattcagtaggctacaattcattactatcagtatttattttgatgtataaattgtcctggatttggccagtgggagccccttcaagctggttcctgtgtctttctcgaatgtctttatcatttttgattaatttctgactttcctaccattgcctattcaaggtgctagaaaaaggctcctgtttcaaattcctaccaaactgctgatttcctctttctctcaccctggccatgtgtctctgtcaagataaaaaaaagcactgcaagaggctgggcgtggtggctcactcctgtaatcccaacactttgggaggctgaggagggcggatcacctgaggtcaggagttcaagaccagcctggctaacatggtgaaaccccatctctactgaaaaaaatacaaaaatttgccaggcgtggtggcccatgcctgtagtcccagctacgcaggaggctgaggcaggagaatcacttcaacccaggaggcggagtttgcagtgagctgaaatagtgccactgcaatccagcctgggcggcagagcgagacttcatctcaaagaaaaaataaaaaataaaaagaagcactgcaaaagagataaaatgtagttacccacagggcagagattctctctctctctcttttttttttttttgaaacagggtttcactccgtcacccaggctggagtgaagtggtaccatcatggctcactgcagcctcaacttcctgggcttaagtgatcctcccacctcagccacctgagtagctgagactacaggtgtgtgccaccatgctggactaatttttattattttttactttttgtaggacagggtcttgccatgttgccctggatggtctggaactcctgggctcaagcagtcctcccactttgcctaccaatgtgctgggattatacatgtgggccattgcgtcctccctggaccgagattcttgaatatgtagtgcccagcaccagcaggaagtcagtgagtagatttgaccattggttggatgtatatctgtgacttagggtccataaagatcttttgaagaactgggcactaatcccaacttcgcattagacaatgttgccaagcaggtgggttgttttttagcatatttgagaagggggaaagagcccactaactttctgggcaaatttgggcaaattaccaaccattgtgggtctcagtttcgactgttaacagggttgcctgagcattgccagtatatatgatgaagtattggccaggtgtggtggctcttgcctgtaatcccagtctttgggaggtcgaggcgggaggatcgcttgagtccaggagttcaagaacagccgaggcaacatagtacgacctcatctctacaaaaaataaataaaattggccaggtatggtggcacatgcttgtagtcccagatactcaggaggctgaggcatgagaattgcttgagcctgggaggttgaggttacaatgagctgagattgtgccactgcactccagcctgggcgacagagtgagactttgtctcacaaaaaaaaaaaaaaaaaaaaaaaaaagaggagaaagaaaaagaaaacgaagtacttacaaatataagggttggctcctcattggttatcagatggaagacagcccctctttagcccaggacaacgtcgaagattgactagacattcagactcacaagacgatgacagaacgtgctccgatctattcagaaggatggggacagaggccctggcctgccagcagaacaatgccaggctgccttgtgtgaggagtcctggagaatttctcacagcagagtatgtaacatccaggagttatcttagccccatgtgatggtcatggtgcaaacagacggggccttcacagggaggtgcagggtctgcgtgggaagatgcgcaccacagggcagtatctcggggacgtgactttcacaagcgtcactgtcttggttcacctgggctgctataacaaaataccataaattgggtaggttttttggagacggggtctcactgtcacccaggctggagtgcagtggtacgatcatgactcattgcagccttgacatcccaggctcaagtgatcctcctgccccagcctcccaagtatctggaactacaggtgcacgccactacgcctggctaagttttgtatttttagtaaagatggggtttcgctatgttacccaggctggtcttgaacacctgggctcaagtgatccacccgccttggcctcccaaagtgctgggatcacaggcatgagccatcatgcccgtcctgggtagcttttaaactacaaaatttattctcacagttccctgagcttagaaattcaggctcagggtgccagcatggtcaggttgtgacaagggcccttttctgggcggcagactgttcacctctcactgtgtcctcacatgagggaaggggcaaacaggctcctcaggcttcttttataagggcacaagtccaattcatgagggctctgcccccatgatctaatcacctcctaaagccccagtactactgcactggggattagatttcaacacagaattttttttggaggggtgggggggtcacaaacattcagaccatagcagtcaccaaaatgctgagaagttcaaagcatggcgtctacatcagatatttaaattccattcctagctactcccagtccatatgtaattcaccagtcaggggccatttttaccataagcaatgttgcctggcaatgtagttgacatatagcatcttaactggtttacagggtgaggcaggcagaataatggcttcccaaagttatctgtgtcctactccccagaacctgtgaacatgataatgggggttttaggttgcagatgcaattaactaaggttgctaactagctgaccttaagacaggcaggttatcatggattatcctagtggaccctatgcaatcacaaggggccttgtaagtgaaagagtgaggcaggagagtcggtgtcagtcagagagagagatgaagatgctacactgctggctttgaaggtggaagggggccacaagtgaagggaagtgtccagcctctagaagctggaaaaggcaagaaggattttctcctggtgtttcctgaagaaacacagctctgccaacagcttggttttaccctactgagattcattttggacttctgacctctagaactgtaatataataaactggtgttaagtcactaagcatgtggtaacttgctacggcagcaatacagggtaacagagctaggtagttgccaaggttgggttctcatgcagcagaggaagagggtgtgtgaacctttcaagcagtcctgacatataaggctggcaatcttcacctcctgggttcaagtgatcctcccacctcagcctcctgagtagctgggaccacaggtgtgagtcaccacgactggctaatttttgtatttattgtagagacgggcttcatcatattacccaggctggtgtcaaaatcctgagctcaagtgatctgcctgcctcagccttccaaagtgttggaattacaggcgtgagccgctgcgcctggcctagattctccatttcttctgtgtgatctttggttgtttgtgttttccatagaatttatccatttcatttcagctgctgaatttatggccataacattctttgtaatatcctttttatgtatgtaggtctgtagtgatgttccgtctttcatttctgatattggtcatttgtattttttttttcttggatggtctggctagagatttatttttatgactcttttcacaaaagcagcttttggtttcattgactcttttttctgtcctcaattttactgatttctgctttattattctatattatttcctttctctgcttcttttgaatttctctctctctctctttagtttattaaagcaaaagctgaggtcagtgattagagagaccttcctttttttctaaaataaacatttttgcctgacacagggatcagggttcaggcagatgggtgcctgtgcagacgtatggactgagctgctcctgccgtagccagcaaccctggggccctgcagctgaggctgcatgggggtggctgctgtctgcttgagtgtcaggcttatttggtgaccatgaagctgctgtacctggccttccacagctgcctcctactggccctgctcagcgcatggtgaactgctcctgaggatcatgcgtcacccacaggcgtgcacgctgtcagtgctacctctttcctgtgggataaactcagcagctgaatctggatgtggcagtgggctgggagcagcctcatcctgctcaactacctggaattgggagtgaggtgggataaggtcactgagcccatgcagggacagaggaacctctcgatgtgctttagttctggagactgctttgctgcccacaatttcagtggcagtcatggattggaaggagtgagctccaggagctctgccgccattctccaggagctagattcctggcccgcacctctgtggaccaggagaacgagagaatgcatagatcgaagaggggaggctgagcacaattgaagtgtggggatatagtctcctctgtgtgaccattatcatggattatcctggtggaaccaattaccatggattatcacaagggaccttgtaagtgaaagggcgagcagaagagtcagtgtcagagtcagagagagatctgaggacgctacactgctggctttgaaggtggaagggggccacaagcgaaggggagtgtgcagcctctagaagctggataaggcaagaaaaaggattctctgtcatgctgttcaatgctgggatgaccatctagtgcaactgaagtgtggggatacgatctcctctatgtgactgtcatctccctctgctccctcatgggcaccatcgtggtgccttcaagaaggccttttacagaaggaagctgctgctccacgtcatagctctggcgattggaatcctctagtccaatgtgctctcctagctcattcctggggcttttgatttcaaccctctggaagatgattatgtgtccaagtctgcagtggtgtctgggggcttttatttttatttttcagagatcttgaagatgtttctcaaacaggaaaatgaacatcacatagacatagccattatgcctctgagaggcttccttccaagaagcaccaggaggaggggggtgatggagaagctgcagaatggggacctggaccacatgagccctcagcactgccacagtgaactggatggcaagcagtccatgatggatgggaaggtcgtggtgggctcactctctgtgctggttctgcaggctccccagagtgcctgctggagctgaaaggtgtccactactttatcagcactctggcctgggtgatcaccctaagcaacagcctccacaatgtcctcagcagcctggccactggcgcctctttcaccgtctgtgtggtccaaggcctcggcacctggtggccgtcttccatgaggagttcccacatgactttgtcatcctgcttagcgctaggaggaccattcagcactgtcttcttcaacccccttccgcctgctgctatgtgggtctggcctttggcatcctggccagcagccacttctctgccaactgaatttttgtgctggttggaggaatgttcttgaatattgctgtggttgatatgttccctgagacgaatgaggtctgccaagaggatgggaggaagggcagcatctccatcccctttgtcattcagaacctgggtctgttggccagattcaccgtcatgctggtcctcgtgatatattcaggacagatccagattgggtagggccctgccaggagcctgtgggatgggaagtcaggccctgggctgcccgatccctggcctgaggactcgccatccacaaagcaccgtggaagaggttgttccatgaaaaacttacacagattgtattcccgccttcagatgtcagcggtgtttacaatgctctgtcctaggaagaaacgtccctagtaaccagtctccaggtagtacctctcaccctctcctcacctccttttctctctgtgactctggaacctgaatgcagcttgcaagacaagcctttttctctgattaccctcgcctctttcccttggaaccagtgctgaaagatgtgtgtgtgtgtgtgtgcgcgcgtgttttgagatggagatttgctctgtcacccaggccggagtgcagtggcacgatgtcagctcactgaaacctccaccttccaggttcaagcgattctcctgcctcagcctccccagtagcagggattacaggcacccacaaacacacctggctaatttttttttttttttttttttcagtagagatgggttttcgccatgctggccaggctggtctcgaactcctgacctcaggtgatccatctgtctcagcctcccaaagtgctgccattacaggcgtgagccactgtgccctgcccagtgccgaaagattttgaatcctttacctgacaatgcaaaaatacagccagtggttttaacttggttagaaatatcaagaggtgaatccatagtttggggcccatgacattggctgggcatcctggacctccggctggccagttttgaaacaggttcacctcttcttacagagaagatgcaggaatccctcttattttttcaaagtctgcttagttgcctattacttctctcagagagaattctaagtgagaacagatgacagggtgagaggggaggcagggatcatccggagtgggagagaaagtgggacggatgctctgtgtcttgtcattttgctcatctgctcctagcagaatgctgggtattgatttgggggcagcacctggtatttcctggctgtccaggtgagctaatgtggaggtaatgtagcttcctggacctcctctttcaggtcaacactgacagaatggaaggtcagagagtctacaaggaaacaatgttttgctgtgattcccacttcccttccccactcctatcttctaagagacttgcaggctgggtgcggtggctcacgcctgtaatcccagcactttgggaggctgaggtgggtggatcacctgaggccaggagttcaagaccagcctgaccaacatagtgaaaccccatctctactaaaaatacaaaaactagccaggtgtgttggtgtgcacctgtagttccagctatttgggaggctgaggcatgagaattgcttgaatctgtgaggcggaggttgcagtgagctgagattgtgccaccgcactccaccctgggcgacagagtgagactctgcctctatctaaaaaaaaaaaaaaaaaaagaaagaaaagaaaagacaagacaagacttgggagctgcctccctaaaagcacattctgagcatatttcagacatctctgttagaaggcagactgcacaaactatcctcccctagtggagatatctgcacagtggcaagctgactggtagaattggaatgcagtttatgctctgcttaaacaagggtaatcagaaatggaatcagtgcaagcaaaatttaggatttgctacttccataaataaaagcatgaataacaggggtctctgaaatgtaaggtcacaaacttagtttggggcactgcagatgtttgcagaatggcagcccagtgattatgctacagatgggctttcaatcacctgtgtaggttaccgcttcctccctcacacacacacaaaaagtggaatccttcgttgaactgaatatgaatatgaattgctctgattctgcccagaaaatggacggatatacttgtctgtaaaaccgtgggccagcctcaggcacgctggatcccttgcctcagaactctggcttcaaggaaagctaatctgcagggctcactgtgtgaatcgatttattactatcacatggataacatgagtttctttagccaatttgggaagccagactctccagaagcctttctcagtggtgcctgcagttgcagcccaggggctgtgttcacaaactgattcgtgtgcatgattcacaagagtactgcttcattgccattgcctaaatttttaatctttttgtttttttttttttgagacagagtctcactctgtcaccgaggctggagtgcagtggcgtgatctcggctcactgcaacctctgtctcctgggttcaagcaattctcctgcctcagcctcctgagtagctgggattacaggcatgtgccaccccacctggctaatttttgtatttttagtagagacggggtttcaccatgttggccgggctggtctcgaactcctgagtccaagtgatcctcccaccttggcttcccaaagtgttgggattataggcgtgagccactgcacgccgccagtgagtttttcatcttcttagacagaaaactgtccactcttagtcattaaaggcagcatcagctgggtgtggtgagttcacgcctgtaatcccagcactttgggaggctgaggtgggaggatcacttgggctgaggagttcaagaccaccctcggcaacattgcaaacgctgtctctaaaaaaaaaaaaaaaaaaaaaaaatttatatatatatatatatacacacacatatatatacacacacacatatatatatatacacacacacatatatatatacacaaaaattaattagctgggtgtggtggtgtgggcctgtagtcccaaatacttgcagggctgaggtgggaggatcacttgatcctgggaggtggaggctgcagtgagccaagattgcgccactgcactccggcctgggtgacagagcaagactgtctcagggaaaaaaacaaaaaagcatcagttttgttttcccttcctgggagacatctctcaaaccagggatattcttgaaaagagcatgagcaaggaaactgctggtgatattacaagtttctctccttatcttgcctgttgacttcaatagatttgagaataggctgaagagggaggaaaacttcagtgattgagattctagatgaaatatcaggactgactcctgataggattatggtccaggttaaccaaaaaccaattccttgaatgttgaaatctaactttttatattatctttattattgttataaaaacagttcttcatcttttctgttttatttttctaaaactgctttcaggagctaccagaaaataacactcaaagtttatgactctggaagattttgctttccctaactcacatcgatgtattaaatgtataattttagcattccctatagatcttcttataccttaaaaataatagcctttgttttggagaagaaagtactaagttagagttagcaggtttcttgtttaggagaggagctcaaaaatataacctttaacaaattgaaaaataaaatatgaaataatagggtgctttctcttttgtgcacagctatattaagaaatttcctttcatagacagctacctcaaagggaaatccttttaaaactttcgttggaggttgggcgtggtggctcacgcctgtaatcccagcgctttgggaggctgaggtgggtggatcacctgaggtcgggagttcgagaccagcctgaccaacatggagaaaccctgtctctattaaaaatataaaaaattaggcgggcatgttggtgcacgtctgtaatcccagctacgtgggtggctgaggcagaagaattgcttgaaccggggaggtggaggttgcggtgagccgagatcacaccattgcactccagcctgggcgacaagagtgaaactctatttcaaaaaacaaaacaaaacaacacaaaactctttgggtgcagaggtcagtcctagtcggaacttagtggggctggagacagtcatattatctcctgactgtaagttgccgttggcaacagctttgcctggtgagttggacttctgggtgttgaatgtgcagtttgtttgtttgtttgtttgtttgtttttgagacggagtctcgctctattgcccagactggagtgcagtggcgtgatctcggctcactgcaagctccgcctcccgcgttcatgccattctcctgcctcagcctcccatgtagctgggactacaggtgcccgccaccacgcccagctaagtttttatatttttagtagagacagggtttcaccgtgttagccaggaaggtctagatctcctgacctcgtgatccacctgcctcggcctctcaaagtgctgggattacaggcgtgagccactgcgcccggccaaatgtgctgttttaagcatttgtacatctagaagtctaaggaatagccagttgttctaaagacttttcacccctggcattagtagcttcaacctctttctggatggaccagcccctgttaatgttaccaaggaaagtacatgtcacatgcaggaacagtaagccagcaccaggtgtctgctccttctcacctagtcactggcaggcaggctgcccctgtccttgctcctacaggtattttgtgtctaatgtcaattttgggggctattcctcattggtccgtcaccttgggtttaaaaaaaaggaggctctgtttgggttgcctaagatctggtcttagtaagccctcttctgacgagatggtaatatgctggagattagccaaaaaaaaaaaaaaagtctaatttttttttaatttttcttttttctttcctttttttctttttctttttcttttcttttcttttttttttttgagacagagtcttgctctgtcacccaggctggagtgcagtggctcaatcttggctcactgcagcctctgcctcctgggtttaagcgatcctcccacctcagcctcctgagtagctgggactacaggtgtgcgccaccatgcctggctaattatttttgtatttctagtagagatggggtttcaccattttggccaggctggtctcaaactcctgaactcaagtgatctgcccacctcagtctcccagcatactgggattacaggtgtgagccactgcacctggcaaaaaaaagttgtccgatatttgtgtgagaggattttattgttcatatttccctttacagttctgcaattccactgcagtattttaccctttttttttttggagacagagtcttgctcagtcacccaggctggagtgcagtggcatgatcacggctcactgcagctttgacctcctgggcttaagtgagcctcctgcctcagcctcctgaatagctgggactacaggagtgcaccaccatgtctggctaatttttgtatttttagtagagatggggttttgccatgttgctcaggttggtctcgaactccaaggttcaagccatcctcccacctcggcctcccagagtgctgggattacaggcatgagccaccgcacctggcctccagcacattgttttaaaaaataactcagctcttatgaaaagaaattagaaaataaaattaacttatgtggactgtaaatgatttgtaagattctataaataaagctatattctataaaaatgaaacgaaataaaatcagcatttaatggtatgaatttccctttaatcactgagtcccacacatttttatatcaattcaaaatattttctaatttctcttttgatttcctttttgaaccatgggctatttagaagtgtgttgttagattaggtgaggttagattctgatctcagcttaatttttagtctttgcaactccaagagacgtgagtagtggtatgaatcctaattctgttctcaaagcttttgctatgttactttggttctgtcctaagcatgtgtagctaaggggtgaggctggaacttttgtggttcataaaaagagttagatgaggctgggcgcggtagctcacacctgtaatcccagcattttgggaggctgagttgggcagatcacttgaggccaggagtttgagaccagctgggccaacatggtgaaaccccatctctactaaaaatacaaaaattcggccaggcacggtggctcacctgaggtcaggtggctcacccagcactttgggaggccgaggcgggtggatcacctgaggtcagcagttcgatcacctgaggtcaggagttcgagaccagcctggccaacatggtgaaaccccgtctctactaaaaatacaaaaattagtcaggtgtggtggtggaccccagctactcaggaggctgaggcagaagaatcgcttgaacctgctgggaggtggaggttgcagtgagccgagattgcaccattgcactctagcctggtgacagagtaagactccatctcaaaaaaaaaaaaaaaaaatagccaggcgtgatggtgcatgcttgtaatcccagctactcgggaggctgaggcaggagaatcgcttgaacccgggaagcagaggttgcagtgagctgagatcgcgccactgcactccaccctgggcaacagagcgagcctctgtttcaagaaaaaaataaaaaagaatgagatgatccacttctcacactctctcctctccagggtttctgccacaccctccagttcaaaagggcaccttttcctgtttccctgaccagaaagacagggtttatcttggagatttagcctgcatgcagccaccactgtgcaattctgaactggggcccgttcttggggcaaagctgtgagagaaaggagaaaaagaaaaaaaaggatcacagggttccctttccccagttcctctcgccagccatgtggggtttccatcagaacattcgctacctgcacggccaccgctgcagccctgctcttgggcccactcaggtcaaagccacaagaataaggagaaaacaaatgtaaaggacactcccatccacacaggtgacttcgtggcttctgcctgtcctccccaatccacatgctcttatgtgattcgtgagtcctcagggagttgctttttatatttttccagcgtttttgctgcagtctgcaggagagacgggctgtagcgggcttgctccatcctgggctctccatatgccactccctctgctgagaacgctcttcctttcttgtctggtgagcacctattccactcccataccttgcatcagctgtcctgacctccagggaatctttcctgacctccagaggatctttcctgaccactttcaccttttaaattcagagcggggggtgcctccgccacagcagcccccctcatcatgctgtctccccagcaaccagcagctggggtaggagaaagacctcctctttcatgcacatctctgtattcccagcttgcaaaaagctgagggaagaatgattatttctattatctatctgattctctactaaagagacaaaatggacatctaaaaatcacaataacacaaaaactccacaatgtttaaatgctgtgagccgaagacggagggtcctccgagcctttgcctggccagagtacaggtgaaaagcacatgcctgaagagcgtggctctagcagtcccttcaaagatcatctagtacttcagtctgtgtggccaattccttttttttttttttttgagacggagtctcgctgtatcacccaggctggagtgcagtggcgtgatcttggctcactgcaacctctgcctcctgggtgcaagcaattctcctgcctcagccccccgagtagctgggattacagccacgcaccaccacgcccggctaatttttgtatttttttttttttagtagagatgggggtttcaccatggtgcccaggctggtctcaaactcctgacctcaagtgacccacccgcctcaacctcccaaagtgttgagattgcaagtgtgagcccccgtgcccggctgccaattccattttgacatgatattgtttcaatagaaaggctatttttacaaagtagaaagtgacagttagaggaaaatgataattttgagttttccatttcattttttaactgaagaaaagacaaaagctgtcatattccagctcctagcattattcaagaagaatgaattttctataaccattcctcgggcaaaccattcatttttacattcctgaagaattaactttgttaaaaaacaggatgtctttgttccagagtatcaaggttttgcttaacattgtgtgcaattttgcttctcatttcatttgcttcctatgagatttttttagcgctaagacagatcaaagaaggtttccttgttgcctttggctccactaccatttcctctcccagctcctcagctaactggttatttgcttggccagtagtgctatttgcaaacaggctcctgaacactgggagaagatggttgctggtaaattgcagcttgtgggaatgtctgcaacacacagctgactttctggaacgtggggaaccgctgacctcaaacgtaggttcaaggaggaaccacagcctgctgaggacccacactgaggtgctggtggatgcgggcagctgccaagctgatgaggaagggtttccaagaagcaggtcagggccccagcctggcaaaggggctctggggctctgggggagggaacgaagattgatgtcttttgcaggccgaccctgtgacccacacaaagccacaagaatgatatccctttcccttgctttctcctcttgccctgggacagtacttttcttccccattttcctagccttcttctgcaaacttcccggcatttaaaaaaaataaactttattttttagagcagttttaggttcatagcaaaggtgagcacaaagtacagagttcccacataactcctgtccccaaataggcgcagcctcccccatgaacatcctgcaccagagtggtccatttgtgaccatcaatgacccaacactgacacatcaatatcacctaaagtccatagtttacaatagggctcactcttggcactgcacattctatgggctttgacagatgtctaatgacaggtgctcactattatggtgtcacacagaggagtttcctgctccacctattcaaccctccccaacgccacattcagagcaggaggtgcctccaccacagcaaccactgatctttatactgattccataattctgccttttccaggatgtcatatagtgggaatcacagtatgtagccttttcagactgatttctttcactcagcaatacgtatgtaagtctcctctatgttgtgtcatgacttgatagctcatttcttttttagtactgaatactattccattttctggatgtttcacagcttatttatccattcacctactgaagaacatcttggttgcttccgagtttgggcaattatgaataaagctgctataaacatctgtgtgcaggttttcgtgtgaacataagttttcaacccaggaaaattccaaggagtgcaattgctatagcatatgggaagaggaggtgtcgttttgtaaggaactgccaaactgtcttccaaagtggctgttgcattttgcattcccaacagcaatgaacaagagtgtctgcttctgcagatcctggcccgctttgtgtattctcagggttgtggattttggccattctaaatggtgtgtagtggtttctcctccttttcatttgcatttccctaatgacatatgatgttgagcttctcttcaaatgccatctttgtatctttggtaagatgccttttcaaaacttttgctcatctttaataggattttgttttgttttgttttctattgagttttaagagttcttttgtattctgagtgacagcatttatcagatgtcttgcaaatgtcttctcccaatctgtgacttgtctgctcattctcttgactttcccaagcttttcaaagctcatagggagggcctgggactagagggaggctagtgagggacctagaacacagaatttaaagaggtgatctatctcagggccttgcaagtgcgatgagacacggccgagtgcctctttaaattctcacctaattctggtcctgctgatgtggtcagacctcagctgcactaatgtccagccccaccgtctactgagcaaactcgtcactctctgataggaccttttccgtgaccattgctgccaagacagcagcttcataaagaacaccaggccgggcacggtggctgatgcttgtgatcccagcactttgggaggccaaggcagtcggatcacctgaggtcaggagttagggaccagcctggccaacatggtgaaaccctgtctctactaaaaatacaaaaattagctgggcgtggtggcacatgcctgtaatcccagctacttgggaggctgaggcaggagaatggcttgaacccaggaggtggagtttgcagtgaactgagattgcatcactgcactccagcctgggtgacagagtgagactctatctcaaaaaaaaaaaaaaaaaaaaaaaaaaaaaaaaaaaaaaaaagaacttagaacccaaattagagactgtctttgggactgggagactttctcatgacaaacaagaggaagagaaatgcaccatcgctactcacagacctgagggaggctctgtcacttggcagcatgactttctgaaagctgtcttatctctcctagcctggggttttcacacctgtggaataggtaaaatgcacttaccccatgacatagttttttgtttgtttgtttgtttttgtttttttgagacagagtctcgctctgtctcccaggctggagtgcagtggcccaatctcagctcacgacaacctccgccttctgggttcaagcaattctcctgcctcagcctcccgagtagctgggactacaggtgtccgccaccatgcccagctaatttttgtatttttagtagagatggggtttcaccatattggccaggctggtctcaaactcctgaccttgtaatctgcccgcctcggcttcccaaagtgctgggattacaggcatgagccaccgcacctggccgacatagttttagatgaaatgagatcatgtgagtgaagggtttggaaaactgtctggtacggcacagggggctgtgaggaagtggcagctctgatcaccactgatgcatgcaggaaccagctgcggcagtcaatctgtgcttcagacttgtgctgcagaccatttacaatggcctctccccaggacactgttggaaactggaaggcttccgggtatgttaacttcatcagagaggaagactggagtatactgaactctttgaaaggaaaatcaggatccttagtttcaaccatgagactggatagtattttgtgatatcaaccaatacttccccattcaaggaagggatgggtgtgatgggttaaaatacagatatggggccgggcgtggtggctcatgcctataatctcagcactttgggaggccgaggtgggaggatcacctgaggtcaggagttcgataccagcccgacgaacatgaagaaaccccgtctctactacaaatacaaaattagctgggcgtggtggcacacacctgtaatcccagctactcaggaggctgaggcaggagaatggcttgaacccgggaggtggaggttgcagtgggctgagattgtgccatcgcactccagcctgggcaacaagagcgaaactctgtctcaacaacaacaacaaagacaacaacaacaacaacaacaaaaaaccagacatggcccaagagtctttctggcttttgtttccaaaagcctaaaccccagaggtgagaaagaattcagagtatcggaggaaaatgtcttggccagaagcaggaggaagaagagcattgcctgcaggaccggagagtgaccctctctgcaagctggggtggttgggggccacaaagccttgttaggagacgggggggggttacaagaccctagaacaaaatggccattgggtgccctgaagcggaggaggtcatgggcagtcttgtggagagttttgtgtccccaggcaggacccaagaccaccaacagcaaccagcctaaagggtccccacccagatgatggtgtcctacgggtcacccagtggacagatacctggtcctgtgtaagttctggggaaacactgaggcaacccaagcaggccaaacaggcagaatgcatgcttcgatttgcgttttaaaacatttagaaaagtcacttttccccgcatatctgaatatggggattgagactcgcatcagccctattcactttgatccgcaggtgctaggtggtggccctttttaaagacagcttccctgcaggaagcccagcctcctttctctgtatggcttctctcagggtttgccattcccttcacttttgcatttgtagagtcttcagcttcctttggttctgagcaggacccaggagatggacatgcatttcctctctgacaaaactggcacttgttctccttggaagcgataaagtcaaacatttgcttgaatttttttttttttttttttgcttttttgtttgtttgtttttagagatggggtctcactctgttgcctaggttggagtgcaatggtgcaatcacagctcattacagcctcaaactcttgggctcaagagatcctcccacttcagcctcctgggtagctgagaccctaggcacgtgccaccatgccccgccaattaaaaaaaaaatgaagacaggggcttgctttgttgcccaggctggtcttaaataactggcttcaagccatcctcccaccttggcctcccaaagtgctgggattacaggtgtgagtcaccataccaagttgggataactcttctgaaatgtcaaatgcaattacaagaagcaaaaaaattggtcccaacttctcccatatggtatgaaaaattaaagaatttcaatgcagttgcctttactctcggggacctaggcctcttccactcgcatgcttttgcttccactattttatctactttacccctccttgactcagcacccaacacttcttgtgaaaagccatctctgccctccttcaagggttcattctgaggctaccagcctctcaaatttttctttcttttttctttctttcttttttttttttttaagattgagtcttgctctgttgcccaggctgaagtgcagtggcatgatctcggctcactgcaagctccacctcctgggttcaagctattcttctgcttcagcgtcccgagtagctgggactagcatgccaccatgcccagctaagttttgtatttttagtaaagatggggttttaccatgttggctaggctggtctcgaactcctgacctcagataatctgcccgcctcagcctcccaaagtgctgggattacaggcatgagccaccatgcctggctcaaagctttcttgagctgggcagccaccttggtccctggacctgagcactccccttcatttctatgacacttctgggtttttactgtcttcatcacattgttcccctctacttatcctttctcatgttggtggacaatgaattatttccaatattttcttttgtacaatgatgttatgagcatgtctcttgcacgataatttttccagggtagatactacaataggattagagttggtgagtagagatgccacacatcttcacttttacacttccctgtctgttaaaatagaatgagtaacctccattccccataacttcacatacactaaacgcacactcacaaaagaggctggtcatctttcttcaagacattcaagaattctcttgtgggactatttcagaaaggtccccacattgtcagcaccttaaagctgccagatacacatcttcaaatgccgtaagtacttgaatgtttgctgctgaaaacagcagcctgtgactcaactacttgaataatcaagaccaacagcctgatgatgccacgctctcatcacttatcagatgccgtcatcaaggctgagcagcaacagccgggtgttttgtttgtcccgggaattctgacgaaagtacacggtttgcaaagtgccagccagcactgcctgagacagcaattcaaggcctctggagcagggtcgcctgtcatacgcaagtcctgtctgatggctcaagctgccccaggaatgaccagaaagtcaccgtgggagtgtggacgcagctcagaatgacctagacgcatggcctgtagacttgagggacacgggctctggaagaggaactctgaaatactactgtagctggtgttagaaaataatcaattgggtggccagaggctgagatggctgttttgcctaggattctgacctaagcaaactaaacccaactcaatgtcaacagtaaaatgaaacgtgagcctaaccaatcaccagctaatttctaatgagagactctcctttttttttttttgagacagagtcttgctctgtcaccccggctggagtgccgtggcacgatctcggctcactgcaagctctgcctcccaggttcaagcgattctcctgcctcagcctcctaagtagctggaattacaggcacgcaccaccatacccagctaatttttgtatttttaatagagatggggtttcaccaggttggccaggctggtctccagctcctgacctcaggtgatccgccctcctcggcctcccaaagtgctgggattacaggtgtgagccactgtgcccagctgagactctccactttaactgatcaagtattttttctttgtcttgcttccaagaacaccttataaatgtttacccctcacgccccctcagtggagccctgaacctcttgcagtttggtgctgtccaattaatgaatcaccctctgctcggataaactctctaaaattgtaatgtgcctaggttgatctttccacactggttacatgctgctctatcagctgagaacctctgggaagcaccgtcctggagcatgcagcactgagggctggtgggcattgatgctctgagcggaggctcggtgcctggaccctaaagtggcttctgcattaacactgtttgcatgcccagcgtagcttacttttttcttttctttctttctttttttttttttcagacagagtcttgctctgttgctcaggctagagtgcagtggtgctatcttggctcagtgcaacctcctcctgggttcaagcgattctcctgcctcagcctcccaagtagctgggattacaggtgtatgccaccacgcccagccaatttttgtatttttagtagagatggggtttcaccatgttggccaggctggtcttgaactcctgacctcaggtgatccacctgccttggcctcccaaagtgccgggattacaggcatgagccaccgcgcctggccagttttttctaattcctatgagtggcaatacgtggatgagttctcagttaaccaaaagatagcaagaatacttccttctgtgcacacctcaaacagcagagtttaagtgaagcctgggagggcctgggaggtcaccagcagagggctgtgtgcggaggcttgctgcttcccagctgaacagcccgtcatgcagggcaaggcttagttgacatgtttttccttctttctttttttaagagacaggttcttgctctgtcaaccaggctggggtgcagcggcaccatcatggctccctgcagccttaaactcctcctgggctcaagtcatcctcctgcctccttcctgaggagctgggattacaggcacacaccaccatgcccagctagttattttattttttgtagagacagggtctcactagattgcttaggctggtctccaactcctgggctcaagcgatcttcccaccctggcctcccaaagtgctgggattacaggcatgagccactgcacccggccaacatgtttctcatctgtgtgcaaagactgaatacctaggctgcaaaatgagctcccagaaatgaattagaaaattctgccttacaagtacaaacagagaagtggttctggagatgtggtttaaccaactggaaaaagtatttttcagacaggaggagtggatgaggagccaggagacttgcttttaatcctatttctatttttaaaaattatttgtatgactttgaacaaggttttttctctttgtgttttagtcttcccttttgtaactgtctgtcgtcttcctgccccaaaacgattagaattaagtaaaatgcctcagctgggaacaaaaccaagatgacgacttggcacattcctagaatattagacattgtcatcggcctttgttgagattaagtaacaacttaatggctcgattctgaaaaaacaaaagcaaaaagaaaaagaaaaaacgtagtcacgtagttttcattctagattagaagcatggatgaaaccgaaagactattcaaagaaaattgcttttaaaagaggaaggaagaactaatcttgaaggctgtcacccacggacactgctgatcatctgttccatacattcaaaggatctctctacggtggttattcagaccttgcagacaggctgatgtctgttgctcaagtacgccatgcatggaagagagtatattggcagcagtgaaaaaaaatataggactcatttaaaaagcctggaaataatctggatactttccaggaaaaacgatgtagagtctgacgcagttgttgttgttttaatgagtgacagcctgctgctggtccctgcgatatggttgttcatggagacttgtccctgagcagcagagctggtggtatgaatggcaggctggggatggagacaagcagggataagttccacttcttcccaggagccaaaaaagccacagatgacaagatctgccctctgtgccagcaccccttcacctgaaatgacagaacttctcatgtaccatatggcgggacagtgctgggaagcctccgagcaagacagtctgccagggaggctggctctggttatttctctttccactttattttaaaatttaaaaaatttttatttttgagacagggtctcattctgttgcccacgctggagtgcagtggtgcaatcatagctcactgcagccttgaactcctgggctcaagtgatcctcttgcctcagcctctcaagctgctgggactacaggtgcatgccactgtgcccagctaatttttaaaattttttgtagagacagaagttcactttgttgcccaggctggcctcaaacccttggcctcttgcaatcctcccacctcagcctcccaaagtgctgggattataggcataagccactgtgctcagcctatttctcctctcaaccaggagtcacctggtggtgggtgaagaagcagctggatgggagaagtccaaccaggataaggccataaaaagcaagaaaaatgtacacatggcccagctcatggacagtctttataagcaaatagggaaggataaaaagacgagaatccaaatgtgagaagcagaaaaataaagctctggtcctaggaaaggttcatggtgggaaatgggaggattcgaaatcagagagagctcagattggggtcctacaggatggcacagttagttccactggtcactaactagtccccactcctccagggagggtgagggatcagctagtctcaaaattaccctccacccctgcaccaggaagactcactctctgtaaagcttcccagtcaatgcccttgtgtcacgagtggttactgtctggggccagtggcacgggcagtaaaaagaatttgccaagacagtcataggtacagaaatgcagatttattagcaaaagcatggaaatatgttgcaagaaagcaataggccagttagcaagagaggagctgactggaggagacaaaggcttcctggggattttataggatggagcttgttctgtgtgctggagagggctaagtgcagtattgataatgtcaaggtggctgtgaactaacttgcatttttctatcaaccgagggtctggtgatatctgggtgcaggaagatcgtgagtcatttgcgcagatgggctatgtgtcctagactatgaagaaacgcagatttatagcttatctgtattttctttctgctttcccttgctcccaccagcctggctccttgttcctaattaggaccccacagtaaggctgccttcctttgctggctggacgcagtggctcacgcctgtaatcccagcactttgggaggctgaggcgggtggatcacctgaggttgggagtttgagatcagcctgaccaacatggagaaaccctgtttctactaaaaaatacaaaattagccaggcgtggtggtgcatgcctcctactcgggaggctgaggcagaagaatagcttgaacccaggaggcggaggttgcagtgagccaagatggtgccattgcactccagcctgcgcgacaagagcaaaactctgtctcaaaaaacaaaaaacaaaacaaaaaaaagaaatacttcctttgctgaagtcagcagctgatagaggaaggcaatacaaagccgggtatagacagtgaataaatttagaaaatgtaccagaacatggcattgttaatgaaccatggagcaccagaaatggaaggattttgcaaaccatggttccaatggttttaaagcgcaaagtttaaacatttataaattaggtcccttctaaagtcaatcagacaaacgcagtctcttacagcctcttatggtttggatatttggatatccaaatctcatattaaaatgtgattcctttgggaggctgagacgggtggatcacctgaggtcagcagttcgagaccagcctgaccaacatggagaaaccctgtctctactaaaaatacaaaatgattcaggtgtggtggtatgcgcctgtaatcccagctacttgggaggctgaggcaggagaatcacttaagcccaggaagtggaggttgcagtgagctgagatcgcaccactggactccagcctgggcaacaagagcaaaactccatctcggcggggaaaaatgtgattcctgatgtatggaggtggggcctggtgggaggcgtttgagtcatgggggtggagccctcctgaggcctccccagaagcagatgctggtgccatgcttgtacaacctgcagaactgtcggctaaataaacctcttttctttatcaatcactgagcctcaagtatttctttatagcaacacaaaaccaactaatacatggctgtattttcagtatctgtcgccacagaagatacaacacgacaaagctgtgattaattcagtaacatacttaaattcatctttattaatcccaaaggcatctatgcatacttgcaaattaatcagcaggatacaaacacatggcagtcgcaattgctctacacaggtttcctgggttgtgcacctgtattcagagaccccttgcagtggctctgaaggcccaccttccaccttgaggaagctgaagggcagaagactgaaggtaacttaacctccttaaccaaccagttagtgtttgagaacctggtattgctgcactgccaggggacacccaggtaatggccaggaaccctcctcttgctagacaggtaagcccagactagtgtagggaggaactggctctctctctgtagagggagaatatcctgagagacagggctgggctgttttcaccgtgcttcctcatacctgcccctcctctgaccagccagagttatccgcactgcctcaaggagaatgaggacgattacacagaagtgcaaagaggaattttgctttttacttccaaagcgggttcagaaagccttcttcaggaacaagttttagacgctaaagcctttgatttatttgaggaaggctctttgggggtctcagaaaaggggaaccccaaaggcaccaggtcctgcggtgaggcctggggcaaggtctaggggagccccgtgtagaggagagcagctggcactgagcagcaggcctgcattccctcatctttgccacatggggagcagtgcctgcagcaagccacggccacgcagaggcacggtgcccacgctgagacctcccatcagagacctcccatcagagacctgcgtatctccatgggtcctccagcagggcaattgcctgtgccctgagatgttggtgagcctcaatcacattcctccatacaacaatctcatgttaagaccagagatccgatgaacccccaaagcagggtgggatccccaatactgacaggcgatggcatgcggatgccccagtgttgtacttctgtacctgggagggacacatcggaactggattctgggaccctatttccttgtaagtgcattctaggtctttccctgctaccccagctgctacctcttacccctagggcaagaggataccctaggaacagtgtggagttcgagtggaagccctgggtgccgtccttgctcctctaggcaccttgtcctgatggtgattctcctttgaaccacagtctcctccttcaagaatggggataaagatccctgcctccccactgcactccagcctgggcgacagagccagactccgtctcaaaaaaaaaaaaaaaaatccctgcctcctggcatttctgtaaagatcaagtggacagggtacatgaatgcttttagcaaactgaaaaatgctaatcaaatgctagtgattgctcctttgaaaatccaagcacagcctgcaaaatacttggaatataaattgagcagacatatcgggagtagtttcaggttatgcttacgtgtcctttatttaaaaaaacaatgcttaaaacaccacctaaaaattcctctgaccacctatttcagtcaaacgctggaagatgggggatgctttatattaaagaattagaatgaggctgggcgcggtggctcacacctgtaatcccagcactttcggaggccaaggtggggggatcacttgaggccaggagttcaagaccagcctgggcaacatggcgaaaccccttctctacgaaaaatacaaaaattagctgggcgcggtggcgcgtgcctgcaataccagctactaggggaggctaaagcatgagaatcgcttgaacctgggaagtggaggttgcaatgagccgagattgcaccactgcactccagcctgggagacagagcaagaccttgtctcaaaaaaaaaaaaaaaaaaaaaattagaatgaggaaaacaatgatgaggtggaaacagatgtttgaacataggagaattttcgatgcataaggatgctgcgggcacttaaccagatgtctgcccttcactacctggccagggtggcacttttaaaccatctgataatggagagaggcggcacagtctgtatgggcacacagctcactctgtggctgaagccacatgtgggtgcactgggcccaaggagctgacctctgctcttgtggcactcccagtccggcacagacttgaggagaccaccgaaaaggagcccaggccaatggcctgcaaagccacttccctctacttgaccaagaagagcttcccggaccctggctcctgcctgcgcatctggccagcttcatcttccaatgctcctggtctccgataagccccagctgctggactgctgtttttaaaccccttccaggcgggaggaacagaagagaggtgagtggacaggtgcaggccctggagcctgaatctgctcctttctagctccggaaatgtgggtaattcccttcacctcctgctttcttcccttcaaaatagaggaatggttgtattggtttctattgtggctacaacacattaccatatatttatggcttaaaacaatgcagttttattattttacagttctggagttcaaaagtctgaaatgggtctcgatggactaaaatcaaggtgccaggagggctgtgggtggaagctctggggagagttcgtatttctgccttttccagtgtctacagccatctgcaatcctgagcttgtggctcctcctgcatttttttttttttttaacattttactttaagttctgggatacatgtgcagaacgtgcaggtgtgttacatagatatacgtgtgccatggtggtttgctgcacctatcaacccatcatctaggttttaagccttgcctgcattaggtatttgtcctaatgctctccctgcccttgcccctcaccccccaacagggctcggtgtgtgatgttcccctccctgtgtccatgtgttctcattgttcaactcccatttatgagtgagaacatgcgatgtttggttttctgttcctgtgttagtttgctgagaatgatggtttccagcttcatccatgtccctgcaaaggacatgaactcattcttttttatggctgcatagtaatccatggtgtatatgtgccacattttctttatccagtctatcattgatgggcatttgggttggttccaagtctttgctattgtaaatagtgctgcaataaacatacatgtgcatgtgtctttatagtagaattatttataatcctttgggtatatacccagtaacgggccctcctgcatttttaaagccagcccagcagcatcccccaccttctctctcagatgcgcctatcttcctcttatgagaacctttgtgacgacactgggcctgccaggtattccaggatcacctccccatctcaggatctttccgttaatcacatctgcaaaatcttttttgctgtgtaagattcacagattcacaagttccaaggattagagggtggccatctttggggaccatgattctacctaccacagtagtcatcaggaataagtagttcatacaacataagccactaagagcctgggctgcaggaagcacttaattaatgtgagccataatcattctcccttgctgaaacagagcccccagcctggaaggctttcgccttgcactggctgtgccccaatagttccatctggccaaatcatgagacctccttccagatgccttccctgtccttctgggccgggcttggtgtccttctgtgttgaggtgggagcttttcttaattccgtgttgtatgctttttttttctgagacagagtcttactctgtcgcccaggctggagtgcagtggcactatcttagctcactgcaacctctgcctcctgggttcaggcgattctcctgcctcacaaccagctaatttttgtattttcagtagagacggggtttcacccacgttggccaggctggtcttgaactcccaatctcaggtgatctgcccgccttggtctcccaaagtgctgggatatcaggcgtgagccaccgtgccccgctctgtgttgtgttataatcctctgtctccctcactggattgtaaatgcctcaggagcagggatggcctctgacttattttgcattcctacccctaggacatggcacacagcagctgtcaaatgtctcctggacggctcatgggtgaaggtaggtctgtgtcctttggggtgtccagaacctcagagctgccgttgctgctgtgggaggggagcagtgagggggtctctaggtggggatcttgtgctctgacagaggcagctcttcagggtggtagctggtttccccacagagaaggctgtctctcaccccaggcagaagaggacagatccatgcattcagcctggggaggagacctggtgttgcaggcacatcatgcttacggtggtcaaaccctcacagccccacgaggagcgggagaggctggcataggacacaagagcctggggatgcttaggcaggttggggggaatcagatatcaggaataaggacccacagaaatcatttggttcaatgcatctcaaatctggtggctgcaaaactcaaagactaattcccggaccctagcccagacccactatgtcagaatgtccaggggatgaggcccaagaagggatattttaaaaactgcccaaaatgtatgcagccaggtttgagaaccactgctgcatctaccttaggctttatacacagactgtgctacaagtaaatggttctcaaaacaggtgtgtaaaacagaagaaaggatacacacatcattcaacagactacagtgaacctgccagaccacgcatcaaggcgaatacataagacagtccttgccaagctgcgtccttgagcccgcctgaatcccggcagggtggagttgagggcggcctctctacttcatttagcccaccagaccttcggacctgagggtctctgatccagcctctcggggccaccaccccctgcagggctccaggaagagtcaaattgcccggtgggccagagctctccctcccttttgttgccgcttggcgcctggcaggtcagaggtcactgggcccagcagccccagtccctggatgggtggagcacccacaaaacagccaggctgtgaagaggcccactttggagtgagaaggggctgcttcttgcgtgtcattttgcaaaaagaatctctgtctcttcctctaccttgagttacactaccaaatactccttttggttaatgtagctttcttatatgctaggggtgagaggaggggaaagccaccttattctgtcaggaaggcacttgggcataaattaatctgtaggccaagtgcagtggctgatgcctgtaattatgcactttgggaggccgaagtgggaggatcacttgaggccaggagttccagaccagcctgggcaacatagtgagaacccatctctacaaaaagttttaaaagaatttagccgggcatggtggtgggcaactgtagccccagctacttaggagactgaagtggaaggctcacttgaactggggagctcaagattgcaatgaaataccatcacatcactgcacaccagcctgggcaacagagcaagaccctgcctctaaaactaaataaataatcggcggggcacagtggctcacgcccgtaatcccagcactttgggaggccgaggcaggcggatcacctgaggtcaggagttctagaccagcctggccaacatggtgaaaccctgtctctactaaaaatacaaaaaattagctggcgtggtggcgggcgcctgtaatcccagccgctagggaggctgaggcaggagaatggcttgaacctgggaggtgcaggttgcagtgagccgagatcgcgccactgcactccaacttgggtgacagagcaagactccacctaaaaatataaataaataaataatctgtgactccatcaacactttcacctgttggctccacgtgcatcagatgagctcatttgggaggtcaccttaacctcggatcaacatggcaggtcctcccacaagcagcctatttaaaatgtgagccacccccttccccggaattccctacctcccagccttgttttatttttctctcatgcacttactatatcttaaatgcttatttattcatgtacttgtttaaactacttttgattttctgacttcttatcattggtctgattcctccaccgtaacagaacttccatgagggcggggatttttcgcttcccccgcaactgcctgcgttttcgtagccctagagcttccaacgtacagtgcggaaaagcaacataacacactaagaaccgtgcggaaaaggagagaaaaccagaccgcaggggcatttcacagctaaccacagcggtccgaggcgaacgcagggtggaagaacccgagcgaggcccggcaggggcggggtgagccttggccccgctcccgtgcaggtgtcgcgggtaagctgccgcggttactgtgaagcagggccaaggccagccctccgcctcgaggccactggtgcttgggggtgggaaaagagtgaccgggggcaactgagcaaaacatagaacagaaactccctctcgaatagagacccacgcacggaaggatgatacactgtgattccccgacgtgggcctgcagcaagagacgggtgctaacagcgtccgagccaatccgtaagcatcagagggacaaagaaatcataaacaagaggcaggatgcaactgcttcaacgcagaaagaatgagtcatccaggaaggcgaggtggtggcgggttggctgtggttttgcagaggcgggcaggaggggcagggggccagggagagggcagggttgggagggtctcttttaagggaatcctatgcatgaaagtctgtgtaagaaagggtgtgcctcctacagaaggatatttgttttgtcctaaacttgccgtgtgttcttggaggcgcgggcctccctgctgtcatcacacctcggatcaccccaggcaatctcgcccctgtggcttcacctgggtccagccagacctctgctcagctctgcacgtacatgccccctcgatgtcacctcctgacttggcaagtcatacaccctctctctacttgcccagcttcattcacaaaaccaggtcacattacccctcgtccatccatgctcagtctggaaaccctgggatcccagacaccagcctctccctggccctctgtttccaatcagacggccaccccgactgacgctggggccggggcacccttgggcgttatccagtctccctgtcctccctctcctgccccacgcctccgaccttccccacatggcagtcacagccagacggccaaggtggggcctgctgcttcctgcttctgcctgacaatggccctggattccccattcttcacggtcagtctcaccttcacaccccggctctgagcaacctttctgctctctccactcctctttcatgaccctgggcccctgctggccgccctgcctggaaagccctttctcatttgtctggcttgaaaaacctgcctcagctcaccagggccagctcaagactccctctgttgtcacacgctttctgcactgctatcagaaagaactaacactctccctgtctgtgcactaatccagggtaggtgggctgttttcacacatgcaccccctctaggttctgactcctctggagtgcatgaccatatcttatttgtttccctgtcaccagtgcctaaactatctgatgcatatatttattgcaggtgcttatcacacatgcagtcaatgaacacctcacaaatgcaaggttcacatgcagtcttcgatgaacacatcgatcgcatccagcagtatgtctgtattggaaaagtccttccatagcacccagtaatgaaaaggaatgtggcggggagcagtactggacagtaaaactaaaaacaccaggaagatcacagtgagatcagcagagccctagaatggcaaatccatgacaaagaaaatttctgatgaataaaaacgtgcctgggtccaggccagcaattggcttctttcagacactattgactgcaacaaaccctagcacaaggagagggtctaacgagaaacttgttcagaggatgctgacccatccatcagtgagcacagccaacccaaaaaggcggggacgcggcagagcaggggctgagggcacacttgctgcagtgttcacggagcacacacagaaagatctgcccgagagagtccccaaaaggcacaattctacaaggtcaaccaagtggaggggaatggcagtgaaacgccaaactcctactgaaaggttgatgggtacagccttccagagacagggctgggtggcgggaacgcgggcacccagaggtccagatcagcaaaagaggccagtgactctgtctccatcagataaaattcagccacagcgggagggagcgtgtgagacccacgaaggccttgccctggacctacacctcaccctgttccagagagaattcagtggccggcaacactgccagttcccctttatttcccttgaggtcaacattttggaattttctactcacatccaccgagcgaccctcctcggccacctccacacccacactccaggcccaccactgcccttgggcatgagcaagcctgacgctgtctctcatcctggtaacaccttcttccccgcacacaccgtcaaacacatgcacggtgtagactgaagtcatcaggtctccttaaccaggctgcagtcccctagtaccctgccatgcagccccacagctgccggggggataaacaagcaccttcagactagagcagcttctgagtgatacgcaaagttaactggggcacagagaaaacagaattttcccaagattgctgaaggaaaactaaaaccgaatgaggactgactcatgctcgtttagtcggccacaggctaggggcagcggaaaggccctgctggaaatttccatccagggtctgtgcagggcgggtaccccagagccgcagggcagggcagatggctcctcagatcgggctggagagacatccaggaggaggatgccagttgttgggtgtagctggaccttcctatagacagggagccatgggaagacagagaccactgatgaggaaggggagatgcagcagcagacactccgtccacatgggccccgggccgccagagaccccagggcccacgtggacgtgtgggtgttgaagggtaacacgtagccctttccaaggtgtgttgatgacttggctcagcctgcaaagccaggctgcctgtactgctgcctgacctctggcctctggcctccaagagcctgaccctctgggaagacagagtcccagcatggggcatgaccaccccatctgctcttcctgttcatcagtgtctggacctgagccacagagtcctgctgggccattgtggagaagaacctgctctcagccctcagcagcctccctgccctgccctgcctcccaccccaatctcaacagcctcttgctcttttcttcccgccatctaagctcatttctcctctttgggccttcatacatgggtactgctttgctagaaatctctcaattttacctctctgtgtggtgggacaccagaagaaacaaggttgagtttgggtgctggaatttggaggaacatgtaaacactttttctgctgtagttgtagaggtgcttgaataagaatgttcaggctgggcatggtggctcacacctgtaatcccagcactctgggaggccgagtcaggtggatcacctgaggtcaggagttcgagaccagcctgaccaacgtggagaaaccccgtctctactaaaaatacaaaattagccgggcgcggtggcacatgcctgtaatcccagctacttgggaggccaaggcaggagaatcgcttgagcccaggaggcggaggttgcagtgagccaagatcgtgccattgctctccagcctgggagacaagagggaaactcagtctcaaaaaaaaaaaaaaaaaaaaaaaaagaatgtttaaaaagagttaaaaatgttttccttcttcctattttatcgccctgcctctctttctttgttggagcccatatggaggggacagaagacaaggccttacagctgtacattaggcaggggcaccaggaggaggtccaggcactgatgagaaaggcataaaggcacagttaatgccagctcatatgatccatcgtggctgttgtcccgcctcatgcacagggggtgttggggaagaaacaatctctctggcccagagggatacttagagtgcttcttctatctctagggccttccatggcctcagagcacatgtgtcacaccacagaaagccaacccagcaactcagagagaaatggttttagaaatctaagaagcaagagaaacaaatcctcctgggaaaggagctcatgtgcagtgcctgagtgtgggtctctctacagttctccacttttttctcttccacacgtctctgtcactttcacttgtcatttgtgtatacttttcctacatcagttaaaaaaggttcccaccacccaccaaacccgctgccagaacactcctggacagagaggacacaagcagtcactgctgttttttgcaaattagaaacttggcaggtatcctgtgagtatcaaaggagatcatccacatgacacgtctagcccaatcattgcccttctttccccttgttgcccactaacctgggctcctagccctatccgatcctcggagactgggcctttggtgacccacaaacctcacggccatggagacgaacagttcctccatagctccctatacttcctcactcctgggcacccagggctccttccccagtgagcacggcgtcttgcacacagccggctttcccttatctgcatggcacctgtcactctgtctaccaatttccagcagggaatctgattgcccaccagccaccattcagtctaacaagaactccttggcaattagaggaatttggaacgctccagcaagctcactgaactgatctctttttaagcacccattgttttctctgcagtaatttttttctttcagcagcttttctagcccctatttcttaacatttcctaaaatgaaaatttcatttgtgtttttacttttgatcatttattaacagtctttggcttattctttagaggtttttaaccagcttctttcagtctttcggtagtattaccctgcaatctccttttctttcctgataccatttagcttttctgactttcaattaaaatatccttgctatccactgttgataggttatttatgtagtacttatacctctattaaaggagttaaattttggtttctggttttaaaaaagaaacaatctctctacctgaataatacaagtctctatgcctaagtatatctagaatgaataaaaataccaaattttaaaaaaggaaaaccagcaagattagatagcagtatatccttaaaaggtgtttcaagaacaaaaatcaggtaatattttaaagttactacttcaaaattccacgaagaaaggggcaatcttctgacatacattattaggcattctcccctctccaagcagaaactgagacaaactaggaaaaatgtgatagtgaaataagtgagatgcagctataaataaaagaagaaattgttgggtacagaccttagtctttgctttctgcataagcagtagttttgtggtaggcgtgggtttgggcgtgtaggtcttgggggaaggagcattgtacacattttacagtgttcctgccctcctgagacagctgtggctcttgcttccccaggggtcagggtccatgttcccacctcatgttgtttatttattttgaggccagagtgcagtggcaccatctcagctcactgcaacctctgcctcccaggttcaagtgattctcgtgcctcagcctcccaagtagctgggattacaggcgtgcaccaccacgcccgcctaattttttgcatttttagtagatacggggtttcaccacgttggccaggccggtatcggactcctgacctcaagtgatctgcctgcctcggcctctgaaagtgctgggattacaggcgatgttcccacctgatgttctatcatttcaaagaatgcactgaatattgggggacttcagggactgtcacttttgctttaaaaactgtaaagtgaatctaggaaaagctttttttttttctggtttctccaccatcagtttgcatgagaaacgccaatcataggactgctgggaatggccccttagctgtgctgtttctgagccaggcctacatcctccactggcttccttgggcgaattttaaggcctatgagcactggagttgtgcatggaggtgggggccaacaggaagtccattgtcctaaatagtcatttcagcctaactaaccccatggtgaggctgctcattaacaggcaaggcatcactgtaaaccttgcatttgcatttacacctactatttattaagtgccacagccatctcttatcatgaccggtcactgagcaaaccctacatttcaaaaacaatccagtttataggtcctctgtctgtttctccgggctggaaaaggctttccatttatcaacttagttgtccccccagtcgcctcttgcagggaacagggccagatcagatggcggctggttcccctcccccgcctcatacaaaaatcaggaaaaggagttgcgggaggaatcgagaagccggccgcagagcccaggtcccccatggctactgtgaggcattcgccgctgcaaatttcctgtccactgtgggaagcggcacacctcactcatgagcagacgacaggactggcacgttttaatggagcacacgggcgcagcctaggcggccttttgctccggctgagaggcacgggcccggtgccagcatttgacagtcctgggaggcgacgggtagaggagagacgcggcagccgcggggccggggagacggtgggaggcccggcgtccatcatccactttattacttgatcaaactttaacattttcgggtttcctaacaccttagccccaaatactcgaaatgaagcaaatcttaaattaaggagtctttccccaccacgctctgtcctcctccccacttcaccctcccgccgtttcgcgttatttccaaggcaatttaaaaaatcaagccaaacaaagctccccggttgctgccgggcgcgcgcggcgaacgaagcacatttcagttcagcaccagcctcggggacagacgccatcaaggaggtgaggaaaaccaccctcagctgcggtggctccagcgtcaccccgagtgctcccgaggcggcgtctgggctgctggggagccaggagggcttcctcaggcactcgccagaaacatttccccaaagaaaacgcccaaccagccacgccatctcctgccactgaggtccttttccacgggggacgtccccgctgggaaaacagcaaacgctctgtgacctacaaatggaagaggggacccccgagcccccgcctgcctcatgccggagggaccgggcgcccccagccccggaagcccctggacgcgctccgagggggctgtccacacccgcgcgcgggcttccccggggcccggcgggaggtcccgggagaggaggccgagggaaccacaggtctttgtgtcgcgtgcagcagcagctggcggcgtgaggaccacaccggcgccagagccgtctccctaggtccggagactttcaccccgagtttcccttccgcgtctggctgcaccgggctgggctctccccgcggacacccggggctccggccgggcgcccacttacccggagcgggatcacgcgcgggcttcgtctgcagcgcggtgctcgcggggggcggccaggccgagcggcatcgctccgcatcggggcgcgggccgggctcgggtgcaaacgcgcgcctcgtgcccctcccgccgcccgcggggtctccgcgtcccgtcaccggccccgccccgcgccgcgcctcccgccctgcagggcccgaccacgcgggcctgggggcgcaggcggaccctcccccggccctggacgctgggggcttctgctcggccccctgtgccgtgggggcccagactggggaagggagagccggcgactctgcgaccctcgccccc

SEQ ID NO: 2507 - DNA, 103071 bp, Homo sapiens; identical to SEQ ID NO: 2505

SEQ ID NO: 2508 - DNA, 57250 bp, Homo sapiens
tattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccagggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaatgattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaagagtacttaaattaatcacatgcttttccctacaattatacctaagctgagtatatcttcttctgtgataaccagctttgattgaaatgtactcatattaggtaaacattaggcaatgataggaggaaagcaaaactaattctttcaaaatgtcaacaaaatttagaaatatccttcccgatggcactaaaaccctgagaggtatttgcttttattcatactcacacaactttagcatttaaaaactatgagtactaaactgtgaccttcaggatttatgttagatggcagaaagaaaatttgggtattagtctaccatataaatgaacttctttaaaaccaaggttcagaactgagaatcatattggttcctcttcaagttagttcaagttgcccacttcagagatccacaaaatctgacattatttccagaaaccccaaactttggtataagtgaccactgctcaaatatgtgatcacatgatcacacagcattcctgtgagttcctttttgtctgataattatcctaattagctctacagagctatcctgcaatccaggttgaaattcaaactctcagttactactacagatttctgaactaggccaagttttaaccaaaaactataggtaatggtgaattactaattagccacaatgcatcaggatttagaaatattttttcttttataaaataacttggtatttttctgataatcttccaatagataaataaaaacttttcttatgctacagtacaagttgatttttaaggaaatttgtgcaaacattaagaaacaccgcattggttctgggtgaaagtgccagtctggaactctcttgaaagaccatacagtctactgctaaaccctgggactcctcagacttgcactcagattatcgtttgcctgccctgattttagactctgctaattcaagtccctgttatcttgcttgacatcgacaaggatcaccgcaccgttccttcagtttccacagttccgtcagttcccacggagaatactgaggagaagacagcattcctgtctcacaggtcttctcacacagccacagactgtcctgttgagaaacaaccaaagccgatctgagagtggtgaaactgttttaagagcatcagaaagtatgcacgtagacagcttttatgtattctaatgatgctgaaattatttcaaggataactccgtgtgtggaacaactggtgaggtttgggggtggcacctcctgatttgggaaagcaccaggtcccacagtcctgtggctgtggaatacagaaacaaggcggtgtgtggatgaagagttagtcaacaaatgccattccgtaatgaacgattttagaaaccacaagtgagtttcatgtttgctagtaaaggtgtgtctatggcagtattagtaacagctattattctgatggaatgcttacaatattgcagggactgtaccaagtgctttgtaaatatctcacttaaatctcacagtaatgctgtgaggtaggaactatttccctcttaacaattgaggaacaaacgaagagttaaaaaacttgttccaggtcacagggctggtaaatgaagaggagggattaaagactcccaagctcaagttcttaaccactagactatttcctagctacgtgaattggtttctatttccagcaatgtagcagaacacagagagaaactcattcaatgttttgacaacacaaaaatgttggataaaattaaaaacctttataaagcatggctcaactccgtgatcaaagaagaaacagggtaggagaaagcgctgagtcagcctgtgccttgaaggcagctgctgatccttgggtttggaaggccaagcccagggtcaggagactaatgggagactgacacagagctaggatctctgaggggccacagcctcaggggtgataaaacaaaacacactcagcttgtctgtctcagtcttgcccctcagtgggatggaaaggagtctctctcccctcagtgcctacccacagcttgcacttaggtaggtctggggctggtagtcagtctgtgtaagcccaacagttccaagccaaaaatctgaagtattcatagatggtagtattcctagatgcatggcagaaaaaaatgtaaatatgtaaatcctctctgtaggaatgcattttaaatagaggactcagtttccaaagacatgagatggtcacaaaaaaaaaaaaaaaaaaagaccgcatcagaaaacaagcgccatgaacaacagttgtagaaacaacaaactgcaaaatcagacccagcaaagactacagatcccagaattaccagatacaaaaaagaattatattcaaagatgagacaaagtacagcaaaggaatcagactatcaaagtggaccatgtagatgtgggttgatttcttgtcctggactgagagctgctctgggaccccagctctatgcagggcttctaactgacagacactgcatgtgccttctgtcccctgcaccttcgatggccaaagtggaagctgcaagaatccagaacagaaatctctgaagctaaagccagctttgtgcttgatttcttcccagggctctagtttccattttggtctctgcagattcatttttttttctggttcagcaatactgtgttttaaatgatgtcttatatttcatgcagtgtcttatttttatcggtcagaagggttgaaggatccttagactgccacactcaatcagtggattctgtcgttcagttttttttttgagacggagtctcgctctgtcgcccaggctggagtacagtggtgtgatcttggctcactgcaagctctgccccccgggttcatgccattctcctgcctcagccttctgagtagctgggaccacaggcgcccgccactatgcctggctaattttttttgtatttttagtagagatggggtttcaccgtgttagccaggatggtctccatctcctgacctcatgatctgcccgcctcggccttctgttgttaagttttaaagctgcaaataatttctgatcaaatctatggaaactgagtttttttgtaggcaggggaacgttgatttataaccttttgctttaaactcagaaaaatactgtatgagaaataacctagtggattattgtgaattaaagcaacagcataactattatggtagaagatcctcattctttctgcccatggtgtgataaacattacaggttgagcattccaaatctgaaaatttgaaatccaaaatgctccaaaatccaaaacttttttttttttttgagacagggtctctctcactctgttgcccaggtgggagtgcagtggtgcattcacagctccctgcaccctcgacctcccaggctcaagttgatcctcctaccttagcctcctgagtagctgggaccacaggcaggcgctgccatgcccagctaatttttttgtagtttttgtagagacggggggtttcaccatgttgcccaggctggtcttgaactcctgggctcaagtgatacacccaccttggcctcccaaagtgttgggattacaggcatgtgccactatgcccagcccaaaactttttgagagccaacatgacactcaaaggaaatgctcactgaagcatttcagattttcagatttggaatgtgcaacttctaagtataatgcaattattctaaaatccaaaaaaatctgaaatcctaaatacttctggtcccaggcattttggataaagaacactcaacctgtatatagaaatccacctcctcaactcttaagaaccctgaggccatccccaaagacttacctggtatcttttaggtcctatggcagccatccagatgcccatgcttacatcttcaccctatacatggcccataaagtttaaatgtaaaaattttaatgctattttatttgtaaagacaaaaccatagccactcccatcataaaccacctttctacttttttgctctgttattattctaatatgaaatagcaaaaatgggttcacatgaagtcaaagctagtggtctttaatatgaagcacccctgccacaaggtaataagatgaaaccgcgagcagacgacccatccttctcatgtaccttaagcttccaggaagcacttagggcttcctccttaggaataaaaatctttctattcctccagggactatactttttttttttttgagacagagtgtccctctgtcgcccaggctggcatgcagtggcgcaatctcagctcactgcaaactccgcctccgggttcacatgattctcctcctcagcctcccaagtagttgggaatataggtgtgcgcccagctaattttttgtatttttagtagagatagggttctgccatgttggccaggctggttttgaactcctaacctcacgtgatctgcctgccttggcgtccgaaagtgctacaattacaggcatgagccacagtgcccagcctccagggatgacacctgtaaatactagctgaaaacataataagtaggctcaaaaaagatttaggaatagaatttaaaggcaagatttgagggatgtaggggtgcatccttaacctttgagaggtgattcctatacagagaataacgtgcttttccccaaggtaagtgggttctgctttccatgatgggatgccgagtgagatgaaacttggtgtgatgagtgtatacgtaggtgggaaatccttaattttttgtttttattttattttttattatagagatggggtcttgctatgttacccaggctggtcttgaattcctgggctcaagtgatctacccgccttagcctcccaaagtgttgtgattactggcaagagccaccacgccaagctaagaaattcttaattacctgataggtctttaacctccccgagttgcttgccagccacttgacgatgtccttggagatcacatatcctgacccacatgcaaaggcagggtaagcggggctcgggtactccaactcctgccactttccggttcggtcaactgcccaattcagtctgaaactgagatgaaaaataatgtggcctcttgtgttagtctgacacatatcctgccactattaaaacttgactcctttatcatcactacaaaggaataagcttgtagaagtgaggaaagaaaataagaaaatttctttttttttgagatggagttttgctcttgttgctcaggctggagtgtagtggtgccatctcggctcactgcaacctctgcctcctgggttcaagcaattctcctgcctcagcctcccgagtagctgggattacaggcgcacaccatcatgaccagctaattttttatatttttagtagagacagggttttgccatgttgtccaggctggtcttgaactcctgactttgggtgatccaccctcctcagcctcccaaagtgctgggattacaggcgtgagccactgcccttccagaaaaaaattttcttaatctaaggaaaggaattatcatttatccagtgttgttttagataaaagattggttatgttaaattttctcaaagttgcatttgtagagtttctgaatgaaaagcactagaagatcaccctgtgttttagtatatatgaaaacaaaaaaccaaatcactaatccatattgtattcctgaggaagcacagaaaatggtttcagagacgtgtcacaaacgtactctaacaaaatatacagtagcttctaatgtgaataccatttatttctttggcataagaataaaagccatattgttttccctcctttactacattagcctgaggcttttcatttaaaaaataatttcctccaattgtacagtaatataaaatttattattattattaagacagggtctccctctgttgcccaggctggagtgcagttgcaaaatcatagctcactgcagcctccaactcctgggctcaagcagtctccctgcctcagcctctcaagtagctaagggctacaggctcacatcacctttttaattttttgtagggacagggtcttgcaacgttgcccaggctagttttgaactcttggcctcaaaggatcctcccacctcagccttcccaaaactctgggatgacagatgtgagccagcatgactgacctagagtaatgaaatatatataaacccaggagtctagtacgaaattgtatatctcaaccacattttcaaaaaaaaaagatattttatgctttattaattacatttgatcaggtacacgaatgccaatgggctaagaatggttaacttactttccccaccaaaaattaggcccatccagattcttttggacaatcctattaaatacagcttcgaggtctatgtaacagtcatcatctgtcttcagcaacaaattgaagctcgttgtttccacagtcctgttgacacaaaagggataagaaagtcagtgcgaccaaacaaacaaacaccaatgcagtggcgtcactaacactttcattcaaaactgtacctgtcattatctaaatttcttattcctcaaatgttgagaacatttgctctaacaaaattttgctgctatcaactaaggccatcacttggtctttactaaatggcataacacagagaagtactaacctgattttaaaaggcaaagaaagagcatattgaaggaaaatatctggcttaaatggaacatatgttcaaacaaatgcttcttaggcatcattcaactcctgctgccaaatctattaaacgcctgaaccttgccccgtgtgttcttaataacaaaggcccagcataatgaattaggtgttacatctgggcctctcacacagaacgctattgtacaagatgcatccgatgctatttatattacactcaaaatattttatggcttaaaaaaacctgacttattacattgaaacatattttcccttggaaacaacttctagcaattaaaccattataaatgaccttctggaaggcaaaggatagtgacttcattatctagacgtaaaatatataatcatgactaaagacaaaattgactccttcatttcacattgacagtccctgtacatctgtttaaaaatgcagttttgctagggtgccagtcatatgtcagaaatctcaataaaataaatttagaatttcattaggtccaagaatggtgaatttaacaataatgggtccacaccaaatagcatcaccccatgtttctaaagtttatttccaattaacagcagaaggcatacataatatttgctaattagaaatttcatgataaagaatatttaggtcactgataactgaaataatgaggaagaaataatgaaactcatttgtagtgtggagatgggtgatgccagctatggggacgcaggtcccagatcagagtcctgttgaaggttactgcagcgatccagggagagaaggtggcagccaacaatagcggcagcggagactaagggagaggctaagatacttccacgcctaggaaatatcttgctctaaagagtatccggggctgactcttagccctgacttcccacccttgggacttccatgcccattcctcatctcagcctcacctacaattgcaactctcatttgcggccccaaattaaaaggaggttctttttcttactacagctgcctaaacttaacctagtattcgacacacccagatttccaaccctcatttacctctgctctctactcacaggatgagtcccaaattatattaatttgccccagcaggccaggtgtggtggctcacgcctataatcccagcactttgggaggccaaggcaggaagactgcttgagacctcatttctattaaaaaataaataaataaataaataaataatttgccccagctaagaaacattaccttccataaaccaattagaccatctacccctcaggaccagggaactgtatccgtaaagtactgttcttggtaacttcccactctgcctagggcaacagagaagaaaagaaagagacagaccctgggcctcacaccaaggaacagaagaaggtttttaaaaataaaagtgaaaaaaataaaaagtgaataccctttataggtttggcctaatcagagataggtttgaaagttttggctccatggtcaggacagacagtaccaggaaactcaacataaaattttgagatcctagagtaactaataattctaataactatacgttaagattatatagatatataatatgtatgttactattattatatattgttgctgttattcttgttataaaagtaggaattaaaagtaagttccaagaaacactggagggtctgggaaattataaatatgatagattctgggagttgtggaattttagtaagccagccacgtaagagttttagaatcagggaggtagtttttaaacggatggagtagagactggaagtataaagtggatattcagtagaagagaatgcctatcagtaacctaaatgtgagtgactataactggggaatctgggtaggtgggtataaatacaactaaaaatggaccattcccaaactcactgatttttatctaatgctggcttgagacaaccgaggcaagcagaaatgactcaaaatgaatcaactttttttttttttttctttttttttgagacggagtctcactctgctgcccaggctggagtgcagtggtgtgatcttggctcactgcaacctccgccttctgggttcaagtgattttcatgcctcagcccccctgagtggctggcattataggcgctcgccaccacacttggctaatttttgtatttttagtagaaacagggtttcaccatgttggccaggctggtctcagactccagatctcaagtgatctgcctgccttggcttcccaaagtgctgccggcaggcataagccaccagccaatttttgccgtgtttttgataggttaatatcacattgtggatctttatcaaaataaagtggcagcatcttagaagctcagttttcgcaaggaactgggatacaataggtcatatcccaggtgctcagtgtccttaggtttgtttttatttgctgaaatctcagtggtttgaagttgataaattgtctcgatagcaaaagaacaataaggcacagtgtcatgtgcctgtaatcttacctactcaggaggctaaggcaggaggtttgcctgcactcaggagttcaagaccagcctaggaaacccctagtaaggggtttccttacagcctagtaagaccccatctcaaaaaaaaaaaaactaacaataaaacaagttctagctacccaacatttttacaacctaccatctatagaagttcaataattttgcaggaacattacgataagtgtcgacaacatccacaaaaacaatatcatcatagatgctgctttcctccttcagtaaggcatcttcctcatggagattccttatatgatcaataagtctttgagggcgagaatgaaggttgtgtaagagagcatcaccttctataaaggaaaagttgagagttggagaaaaatgctgttgtaaagttaccattcagaactgatgatgtacactaaagttcttttcccaaggtaacccagcagaaacacatgcagttgtttggaactttaggtagaaaaatgggaactctcatacactgccagtaggattaagtggatgctcccactctggaaagcaatttggcaatatctatttaggctgaaaatgtgtacaccttatggttcagttgaggccacttgtagatatatccctactaacattatttcacatgaggatattaattacagcattgtttgtaattgtggaagaaaaatgggaccaacctaaatgtccactgagagaaaaaaaaaaaacagccaagttgtggtatattcacataatgaaatatagcagttaaaaaaattaccctgatcttgcatgttaaaaggattgggatgaaaaaataaagttgagtgaaaattgccaagtgataaatacaatatgacaccacagatatcaattataaaacactcaaaactatgttatttaaagacatggtcaggcgtggtggcttatgcctgtaatcccagcactccgtgaagccgagggaggagaatcgcttaagcccaggagtttgagatcactctaggttatatagggagaccccatctctaaataaaatttaaaaattagccaggcatagtggtgcatgcctctggtcccagcttcttgggaggccaaggcaggaggatccctggagcccaggagttcaaggctgcagtgagctatgattacaccactgaactccatccagcctaggcaacacagcgagaccctgtctcaaataaataaataaataaagagacgtaaatatgttcaaagtagaaaaataagaatgggaagggtacacatgaattttagggaagtggcaccccctttgaggagagggaagaggaatacatctagggagaaccacaaggaaaaggtttcaactgtacctacaatgttttcttttttttctttttttgagacagagtctcactctgttgcccaggctggagtgcaatggcatgatcttggctcactgcaacctccacctcccagattcaagtgattctcctgcctcagcctcccgagtagctgggattacaggtgttagctaccacgcccggctaatttttgtatttttagtagagacggagtttcaccatgttggccagctggtctcgaactcctgacctcaaatgatccacctgcctcagcctcccaaagtgctgggattacaggcgtgagccactgcaccaggcatataatgttttctttctttcctctctttttcttttttgtttttgagacacagtctcactctgttgcacagactggagtacaatggcacgatctcagctcactgtaatctccacctcccgggttcaagcattctcctgtctcagcctccctcatgagtagctgggattacaggcgcctgccactgtgcccagctaattgtttgtatttttacaaacaattgtaaaaattgtttgtaacaagaggcagggttttgccatgttggccaggctggtctcgaactcctaacctcaggtgatccacctgcctcagcctcccaaagtgctaagattacaggcatgagcgactgtgcctggccatgttttatttaaaaaaaaaaaaaaaaaattagaaatgaataagaaaaaatgtaaataaaaaattgttaattctgagcactgggtacctggctgtttctgtactatttctggtgtatttatgattatttcctttgtttttttttttttgagacagggtcttgttctatcacccgggctagaatgcagtggtgtaattatagcttactgcagcctcaacttcctgggctcaagtgatcctcccacctcagcttcccaagtagctggtactcccggcacctgtcaccatacccaggaaattttcaagttttttgtagagatggggtctcgctatgttgtccaggctggtctctaaatcctgggctcaagagatcctcttgcctcccaagtttctgggagcctcccaaagttctgggactacaggcgagagccactatgcctggccatgatatttcataataaaaatgattactaatgtgcttaaaagacaatttatttgccacttcacaagttaatgagtcacttgtcacgtgtgcagggactgtccccagatcctactgatttaaggcaattctttcgctgtggcaggagacgtcaggatttcctaaaaatgtctcaatcaaattaaagaaaaattttgaaaaatacaaagaaaatgagctgctgagggtggcaaaggaaatgaaatacaatttagcactgcactctttgtcactgcaaatggaaaggatgaggtgggaagctgaaggcctatatctgacttctgcctctcatgacttgtgagatactggacaagttctgttgtctctagaccacagcagtctcacctgtagaaaatggtgctggattcaatcagtgattcttgggaatgcttgctgaaatgcagattcctgggccccaagcctaaagattcagtaggtctggggtggagcccaggaatctattttttttccttctgcacctgctcccaggaatctatatttttaatggccactgctgcgaccctgatgcaggtaggcagaacacagaccagcctttgagaaacacaggggtagatgacctcctgtttttttttttttttttttttttttttttgagatggagtctcactctgtcacccaggctggagtgcagtagcgctatctcggctcactgcaacctctgcctcccaggttcaagcgattctcctacctgagcctctcgagtagctaggattacaggcgtgcgccaccatgcctagctaatttttgtatttttagtatagatggggtttcaccatgttggtctggctggtctcgaactcctgacctcgtgatccacctgccttggcctcccaaagtgctgggattacaggcattgagctactgcacctggcctgacctcctgtttagacttacaatttttggactttacgataatgtaaaaacaatatgtgttcaccagaaaccatgctttgagtacatatgcaaccattctgtttctcatgtgactacagtcttgtgagatgttcaacctttattatggaataggctttgtgttagattattttgcccaactgtgggctaatgtaagtgtcctgagcaagtttaaggtaggtgaggctaagctataacattcggcaggctaagtgtatgaaatgcattttcaacatacatttttaacttaacatgggttcaacaggatgtaacattgtaagtcaaggagcatctgtataatttaacacttgatggaaagtgaaagtgttataaaattgtaacaggaaaatggcttgtaacaacaggagtgcagaaattaaatacaagccttttagactagtaacacattttgtttcactgcatgtatctgaaaaatatgagcataaattaatatgtcaggaaaatgaaaggatgtctgcttttgccacttctattcaacatacatgttctagccaggacaatcagataagaaaaaaggcatccagattgaaaaggaagaagcaaaactctctcttcttacagatgaaatgaccttgcatgtagaaaatcataaggtctaactttaaaatgattaagtaataaatacatggatctgttcagcaatgttgcagcacacagatcaatcacaaaaacaatctgtatgtctatatactcgcaatgaacaatcttaaaattaaattagaaaaacaattccacttacaacagcatcaaaaagataacataagtatttaataatttaacaaaagaagtgcaagacttttatactgaaaaatcaaacatcattgaaggaaatttaataagacatggatgttcaaagacttaatactgttaacacggcaatactccccaggttgatccacagatagaatgcaatccctgatgggaatgtgaactagtacaaccactatggaaaacagtgtggagattccttgaagaactaaaggtagatctaccatttgatccagcgatcccattaggaaagtaagtcattatatgaaaaagatacttgcacatgcatgtttatagcagcacaatttgcaactgcaaaaatatggaaccagcccaaatgcccatcaatcaatgagtaaagaaaatgtggtatatatatatataccatggagtactactcagccataaaaagaaacaaaataatggcattcacagcacctgcgtgcagctggaggccattattctaagtaaagtaactcaggaatggaaatccaaacatcgtatgttctcactcataagtgggagctaagctatgaggatgcaaaggcataagaatgatacaatggactttggggacttggtggggacagggtgggagggggtaggaataagactacacactggttacagtgtacactgcttgggtgatgggtgcaccaaaatctcagaaatcaccgctaaagaacttattcatgtaatcaaacaccacctgctcccccaaaaccgattgaaattatatatttattcatatatatgcatatatatatatgcaatcccttaaaacattccagctaggttttcttttttttttttgcacaaattaacaagctgatcataaaattcatatggaagtgcaagagacccagaatagccaatcaagcttgaaaaagaacaaggttggaggattcacatttcctaatttcttttttttttttttttttttttgagacggagtcttgctgtcacccaggatgaaatgcagtggcaatctcagctcaatgcaacctctgcctcccaggttcaagcgattcttctgcctcagcctctggagtagctgggattacaggcgcccgacaccatgcctggctaatttttttgtatttttagtagagacagggtttcaccatgttggtcaggctggtctcgaactcctgacctcgtgatccacctgcctcgggctcccaaagtgctgggattacaggagtgagccaccgtgcccagcctcccaatttcaaatcttactaaaaagctacataatcaagacagtgtagtactggttaaagacgcagacacatagatcaatggaatagaattgagagtcctcaagtaaatccttacatctacagtcactgattttcaacaaatgggtgctgggacaactggatatccacatgcaaaagaatgaagttaaacctctatttcatgccatatatgaaaatgaacatggatccaagacctacgtataagtgctaaaactataaaactcttggaactgtaaaacaaaggcacaaatctttgtgacctcacattagacaatagttccttacatatgacagcaaaaacatgtgacaaaattggacttcatcaaaatttacaacttttgtgtgttaaagggcaccatttgcaaagcatgtatctgataagggacttgtatccagcatatataaagaactcttacaattcaacaataacaaaataattttataaatgggcaaaggatctgaatagatatttctctaaagatatacaaatgactctctctcccctcctttcctcccttcttccctccacccctccctccctcaccaccttctccctctctccaccccttcctccctcacttcctccccctcctccctccctcacttcccacatctagctcatataccataataattcaccctgttaacagtgtgcagcctcagcaatatgacaaaaccctgtctctacaaaacatttaataattagctgggcatggtggcatgcacttgtagtcccagctattcgggaggctgaaatgggaagttcacttgagcccggggaggtcaaggctacagtgagctgtgatcatgccactgcactccagcctgggcaacagagtgaggcctcgtctcagaaaaaaagaaaaacaacgaaacaaaaaaggaagatatacaaatggccaataagcacatgaagaaaatgctcaacatcattagttattatggaaatacgaataaaaatcacaatgaaataacaatttacacccactaggattggtatattttaaaagacagacaatttattaagtgttgacaagaatatggagaaactagaatcctcatatactgactatggaaatgtaaagtgggctgctgctttagaaaacaacctggcagtgcctcaagtgattaaacacacaattatatgacccaggtcttctactcctagacatttaagagaaatggaaatatatgaccacacaaaaacttgtacctacatgtttactacagaattattcatattcaaaaagtagaagcaatctaaatgtccatccattaatgaatgaataaaatagggcatatcgatgcaatagaatattatatgatcataaaaaagaagtactgatacatacaaaatggacagacctggaacacatgttacagcaaagaaactgacacacagagtacgtactgtgcatttccatttatgtgaaatgttcaaaacaggcaaatccatagagaaagaaagtgcatcagtagttgttagggggtggggggttggggaggtaagaatgaggagtaactgctaatgggtgtggggtttccttttgggaggtggagccggttgtagaactctaagaatacactaaaaccactgaaccactttaaaagggtgaattttatctgaataaagttttttaaaagacaaaaaagaaaaaatccttttctctcaagtataaagattaagtgtaagacattcagtgtacttttcaagtttcaactagcaaacttaccctgaatagtatatataaaaccacctgcaactccctccacaccttccaagaattcatgaggcaatgcaccctccccagcctgaaaggaataagaatgtactcagtgattcattactaaaaatacactgatcatattttaaaatcgatttgacaaaaatcataatatgactccacttgcagcagataaatgcatgtaagatgctggtgcactggaggcttataatatcaggatgacatacggtattctactatttttgttatctaattacaatactaaagataagatatacccaacattccataaggtgttcagaattgcaacttacatagaatcatgtttatgtacttgctactctagtagtacaaaaagcaattgattttacatcccaaccccaccacttaaaaaaatatgtattacgacctttgattttttggaaactaaaaattctcatgagttcaaatacatcttggcatgctttaaagttaagagaccatgcagagaaaggctcaaaattaacagtctgttccaaatattcaaattgaactctactgtatattgattaaaaaaaaatttttttttaatttttaatttttcttttttttttttttcaaataagagacagtgtttcaccatattggtcaggctggtctcgaactcctgacctcaggtgatccgcctgcctcagcctcccacagtgctgggattacaggcgtgagccaccacacccggcctaatttcattttacagacagggtttcactctgatgctcaggctgagtgcagtggtgcaatgatatctcattctagccttgaacatacaatcttcccatctcagccttacaagcagctggcactacaggtgtgcaccaccatgcccagctaatatttataaattttttgtagagaagaggtctcactgtgctgcccaggctggtcttgaactcctgggctcaagtgatcctcccgcctcggtctcccaaagtgctgggattacaggtgtgggccactgtgcccagcctgttgatgttgttgaaggtgcttaagcctattgtgccagcagccaatgacagtcctttctacttcttagaatggagaatcttttattattaaagagttatctctcttcaaaagttacccaatggccttactcagagtgaactgttttacttctgtatacagtaaaccactatggtacatctaccagagtattgtctggctgttgtgggctagatcagacagttaagagtccatactcagtgtatttacagtattttttctacaccttcatttaatcaagagagctactgcttggctattcttaaacagatcttttcagagttgtactgtacaaagcaatgttttaaggccagtagaagaagtaatctgaggtcactgtagtaacttgtcatttaatttaaaatatgtttgtaggccaggcgcagtggctcacacctgtaatcccagcactttgggaggcggaggcgggcggatcacgaggacaagacatcaagaccatcctagctaatacggtgaaaccctgtctctactaaaaatacagaaaaattagctaggcatggtggtgtgtgcctataatcccagctactctggaggctgaggcaggagtatcacttgaacctgggagaaggagattgcagtgagccaagactgtgccactgtactccagcctgggtgacagagtgagactccatctcaaaaaaataaataaaataaaataaaataaaagttcgtagccaaatgtgaaaattactaaaggggcaggctatagattccaacgttgtagttccataaaagactgtatatgctttatttgttatttacttatttactttttttttttttttttgagacgaagtcttgctcttgtcccccaggctggagtgcgatggcgtgatttcggctcactgcaacatctgcctcgggggttcaagcgattctcttgcctcagcctctcaagtagctgacagtcgcctgccagcacacctggctaatttttgtatttttagtagagacggggtttcaccatgttggccaggctggtctcgaactcctgacctcaggtgatccgcctgtctcggcctcctaaagtgctgggattacaggtgtgagccaccgcgcccggcctacttatttagttttttgagatggagtttcactcttgtcgcccaggctggagtgcaatggcgtgatcttggctcactgcaacctctgcctcccgggttcaagtgattctcctttctcagcctcttgagtagctgggattacgggcattagccatcacgcctggctaatttttatatttttagtagagacggggtttcaccatgttggtcaggctggtctcgaactcctgacttcaggtgatctgcccaactcagcctcccaaaatgctgggattacaggcgtgagccacagcacccagcctatgctttattttttattgtatatttctatattgttttggctttagaactcaatagtaatttctgtttattaacttctctctaaaaggtcacaacttggctttttgcctttaaaatttttctgacatcacttgctggcaagggaataaagcttagtgaaaactctcagctgtacgcatttgtgatgaaaatcttaatttgtacctggggtttcttagcgtaggctttaaaaagttacctggttttgtttttgtttttttaggttaactgtatgtttaagctatctttagccctctataataatttttactcccaaaggcagatcatttgagtctttacatttgaacctagttctcaactcagaaacctaccttttttttttttttttttttgcgacggagtctcgcactgtagccaggctggagtgcagtggcgcgatcttggctcactgcaacctccacctcctgggttcaagcaattctcctgcctcagccttccgagtagctgggactacaggcacccgccaccacagccagctaatttttgtatttttagtagagacggggtttcaccatgttggccaggctggtcttgatctcttgacctcgtgatcctcccacctcagcctcccgaagtgctgggattacggcgtgagccaccgcgcccggccaatttatttcttttagtgtaaccaatattatagaattttggcatatgctgggtattttaaagtttcataaatagaaaaggaggcaagataataaggaaagatataattccataaaactttctattttcagtaaaaaatttttcataagacttaaaatgaactttagtaaacaagtggtgtgtgtgtttactaaagtaaacaccatctttattgtcctccatttactttatgaaatttacctgtcataataaatcctaaatcctaaacatgaatgaaatcctaaacatggcctacaaatctaaatgtataactacatatgaatctatgggtctatttgtttaatgtctttcttcctcactggactgtaagttccacggtgggccactagtatgtctattttaccctgccattgtttctgccttaccacaggtatgcaggaaatgttttttgaatgagtaataacgtagcatatattcatttcaactcagaaattaatccatgtaaatgaggttaatattcattcactaagcttgtgaatttaaatgccaagtacattcctaatcattggacaggagatcgaggagaataaaagattgtctatgattccaccgtacagaccgtttgtttactaaagttcattttaagtcttcatatacctgctttattgacctatatttactttgagaaattcacctgtcaaactgttttaaatttaaagcaaagccgaatgagaaatatgagagtcagaaatcccagagttgcttcagcaaaataaatgaaagtactcaatcttattttctatttttttttgttttgttttgagatggagtctcgctctgttgcccaggttggagtgcagtggcatgatcctggctcactgcaacctccacctctggggttcaagcaatcctcccacctcagcctcccaagtagctaggattacaggcatgcaccaccaggcccagctaattttttttttttttggatttttagtagaaacggggtttcaccatgttggccaggctggtcttgacctcctgacctccagtggtccacccaccttagcctcccaaagtgctcggattacaggcataagccagcacaccccgccttattttccaatatttttatctatagtagttttttttgtttgtttgttttttttgagacagagtctcactctgccacccaggctggagtgcagtggtgtgatctcagctcactggaacttctgcctcctaggttcaagcaattctcatgcctcagccacctgagtagctgggattccaggcatgcgccaccatgcctggctaagtttttgtatttttagtacagatggggtcttgctatgttgcccaggctggtgttaaactcctggcctcaagtgatccacctgcctcagcctcctaaagttctgggattattggcatgagccaccgcacctggctaattatagtattttaactgaggttttattttcaaggtgagatagtaaatactctgaatactactgagcaagtattcttaaagaatgctaacttaaaaattactgagaaataggccaggtgcagtggctcatgcctgtaatacagcactttgggaagcgtaggtgggcggatcacttgagcccagaagtttgcaaccagcctaggcaacatggtgaaaccccatctctacaaaaaacacaaaaagttagctgggtgtagtggtgcgcacctgtagccccagctacatgggaggattgtttaagccaggaggtggaggctgcagtgagctgtgatcgtgctagtgcaccccagcctgtgcaacaaagtgagaccctctcaaaaaaaaaaaaaaaaaagagaaataaaatattgcattttaaaaatgcatcaatcttaaagcaaaactgtaaactcactaatgctggagttacaggatcatatttgagtttttgcctttactatgaagacaacaacatttgctactatatatgttgtaaaacacacaagaatcattgctccatgctgcctgggctctaaggtaaattttagaacaattttatatattaaaaagaagctaaaatatgcaattaaaccttaaaaaaaaacgacttactgtaatgactctgagaactccccctccatcattcactgtcactttgtggagatttcttgacacaaggccgtggaggtcttggctctcccacacgattgtaccttcaaagctcttttgtagaaagatgaatagtgagtcaatttccttattgctgtcatttaggttttaagtatgctttcaggcaagatttttagagaaaatttttcccaaaacgtatcatttaaaattttcaccccataactctgacataccactgttagcgtttggtgtgtatccttgaccgttttttccatgcacatataaaaaaccaattacaaagagtatatacacaattttgcatactgctgtttgccatttcccattgtatcaaaagcatttccttatgttgttgcagctgtcacagccattcttcctcatgtgtgtataacatcccaatgagcagatacaccctgatttactcattttcccctactattagacatttggttgctactaaatgtctactaaaatatctactaagtatctactaaaataatgtaggcatgttttggtgtacatgtttatttactcctaacaatttgttttgtacttacattcccagagtgaaattactgggacaagaaagagatatttttatggattttggtatacaccgccaactgctttttgaaagcaacttttactaatttatagggttatcagcaatgtatgagaatgacaactgcactgtattctccctggtatgggatactagtaaacaaaagtttaacctaatatactagatttttacaaaatgattccttatttagttggatttatttttcagtttttgacacagagcctcgctctgccacccaggctggagtgcaatggtgcgatcatggctcactgcaaccttcactctccaggtttaagcgattctcttgcttcagcctcccgcgtagctgggattacaggcgctcactatcacgcccggttaatttttggatatttagtagagacagggtttcgccatgttggccaggctggtctggaactcctgacctcaagtgatctgcccaccctggcctcccaaagtgctgggattacaggcatgagccacggcgccctgcctgaatttaaaaaaaaaaaaaaaagattggcttagttggatttctgattcctagtgatgtttatgaattgcatgttctcttctgaggactgccttatcatgctgctttgccatctgccctctgagttttctatttttcttgttcatctatgcaagcttttaataaagtaattatcttaatcctgtgcacattttatatgctaaaatagtttttcatttgctacttaatgctatttttgaaattcagaagtccataaatttcaccttggcaaatctgacaaacttttcctttgtgattattactattaaattctgagctgagagagctatgcccccctgtcccaaggtctgatatatattgaaatcttaatgtcttctaatttctccatgatcccatttttaattctgtgcacagctggctccttagtcctgctcaggtctcagctccactaccttctcctccgagaggctttctccagatgtcctccagaaggctccaactcccaacttctatcacatcaacctgttttatcttattaataccatttatcactctgatatttcttattttattttattattaaactaactgcctctactagaagacaaacaccttgagaacaggaaggagcttgcctgatcaaccactgcatccccagcatcgagcctggcctgacatgactgacaactcaaaatgtttgctgaataaataatgttgaactaaaaatcaaccagaattgactatagtatagaggattaaatgaaagatatacctctaatactctaaaaactttcatgttaaaatgaagggataaagtactttacaataatgtctcattttagccagcagtatagggaaaccatacaaaattcaatttgataagctaggtcagtggtttataaacatttttttccctctgcacagagtgatataaactttttctttttttttatttttatttttttgagacggagtctcactctgtagcccaggctggagtgcagtggcatgatctctgctcactgcaaaccccacctcccaggtcctggttcaagtgattctcctgcctcagcctcccaagtagctgggattacaggaatgtgccaccatgcctagctaatttttgtattttcagtagagatggggtttcaccatgttggccaggctggtcttgaactcctgacctagtgatctgcctgcctcagcctcccaaagtgctaggattacgggcgtgagccaccgcccaacctttcccttcctttctttccttttttaaaataaataatatttttttcctcctccaaaacagataaaaatattccaagagtccggattcctcaggcagtttatcgctctgtattcagctaatgtattttcttctaaaactttaatagtgatagagtttggaaggattgatagcatatatacttaggataaggaactgataggacttggtgagtacctggacatgagagtgacgataactctcatgattctggtttaggtgacttgaggaaaaggagatggttacccaagattaaaaatacaggcgatgagaacagatgggatggagacaatgttaccattagaatgcccatgggacattcaagtggagaagttcaggaggcaactcaaagcatgtctggagttcacaagagatgctggggctgtaattatagatttaacagccttcagcatacaggcagtaatgaatgaaattgcctgggaagaatgagtaaaataaaacagaaggctaggtagcaaatcctaatgattaatatttaagaggaaagcaaaaaggaaataatgaatcataccaaaagtaaaaactatagtgaccagataaaaatcctcaccttgaaactacaaatctagaaaagatgatgataaaacgagtaattctctgtactgtccattcaattgacatgacatgtgacatgctatttcacagtgggtccttcctggcacccaactccattttgtctgtgactaggctatgatacaacaaacaaattcaatgaataattgaatgtgttaccagaaaaattccctagtcctcccaaatcatcttgacttactcatggaacttaaataacccatcagctgttttgttactaagcaaggaagaagctttatcttccacctgtctcctaaacctgtttctgctccacaacacagtttaatttctattcctcacctctgctctcatacacctactttttattctgatgtaaggcaattatgaagccaggtatctcttaagatccaaaacaacttgtttatggcaattcccttactaagatcataaaaaccaaaataaaagttgggaaaaaatagcatgatacaggttggaaaaatgagatatcatatctatctctcccataacataagcaagctgtctgtaactcctttcacgcatcaactcttttccataaagcttctaatttctcatccaaacaacagagtagcttaaatatatacagtacttctgtgcctataaacattaacaacttcttgtggattggagaaatgactatatataaagaatttcaaccttcacaaaaaataaggatataggctgggcacggtggctcacacctgtaatcccagcactttgggaggccgaggtgggtggatcacctgaggtcaggagttcaaaaccagcctggccaacatggtgaaaccctgtctctattaaaaataaaaaaaattagccaggtgtggtggcaggcactcgtaatcccagctattcaggaggctgaggcaggagaatcatttgaacctgggaggtggaggttgcagtgagccaagattgagccattgcactccagcctgggcaacaggagtgaaattctgtctaaggatgtaagcgtccataatgctaacaataacgtcgctagtgacttaggtgaacaaaaatagtctgctttttactgaaattagttacaggttccaactgtaccattaaggacaacataaaattagagacatatatatatatatatatatatatatatatatatatatatatttttttttttttttttttttgagacggagtctcgctctgtctctgtcactcaggctggagtgcagtggtatgatcttggctcactacaacctctgcctcccaggttcaagtgattctcctgcctcagccttctggtagctgggactacaggcatgcgccaccacacctggctaattttttgtatttttagtagagatggggtttcaccatgttagccaggatggtctggatttcctgacctcatgatccacccgcctcggcctcccaaagtgctgggattacagatgtgagccaccacgcccagccaaaacataaatattttaagagaaacacacagtagtcttcacttgtgaagaatcacttgtgatgcccactgagatttatgcttcagtgagctacacaatgaaaaccttacaggcgacctgcttactggacaagctatactgccgacgtgtgactccaggcaatcaccaagtgtggagggaatacgatgatgaacttcctctcgcaaatggaatacactacctacttctcttctgttactctttgctgatgatatgccagcaaacaatcactatcattcttccgagcaaacaaacccaatcagccttgatgcagtaaaaaaaaggatttaaaattaaacatattttcaacacaaatagaattttgtacaacaggagagaatttttttaattgctaaaagtttattttttctttctattatataaagctaatatatgtttattatggaacatttagaagatagatatacaaaaagaagaaaattaaaatcatccataatcttagctccccaccaggtatagccactattaaataattgcttgctttttgtgtgtgtggttatttttgttgtttgaatagggactgggtttcatcaagttgcccaggctggtcgtctcaaactcatgggctcaatgatctgcccgcctcggcctcccaaagtgctgggaggataagcctgagacaccacacgtggcctgcttgttttttaaaagaaaaaatattatacaaaattaataaaggtaataaaatcaagtctatttagcctaaagcctgaagggagataaaaagcacaaggctatagtcattaaaactcttaataactagacctggtggccaggcgcagtggctcatgcctgtaatcccagcactttgggaggccaaggcaggcgggcggatcatgagatcaggagatcaagaccatcctggctaacacggtgaaaccccgtctgtactaaaaatacaaaaaattagccaggcgtgatggcacacgcctatagtaccagctactcaggaggctgaggcaggagaattgcttgaacccaagaggcagaggttgcagtgagcggagatcatgccactgcactcccgcctgggtgacagagcgagactccgtttctaaacaaacaaacaaacaaacaaactagacctggtgtggtggctcaagcctgtaatcctagacctttgggaggtgagaggattgcttgaggccagaagttcaagaccagcctgccaacatagcgacacacccatctgtacaagaaataaaaaatttaggccaggcgtggtggctcatgtctgtaatctcagcactttgggaggccaaggtaggtggatcacctggggtcaggagttcgagaccagcctggccaacatggtaaaatcttgtctctactaaaaaatacaaaaattagccggtgtggtggcatgtgcctgtaatcccagctacttgagaggctggggcaggagaatcacttgaacgtgggaggcagaggttgcagtgagccagaatcatgccagtgcactccagcctgggtgacagagcaaaatgctgtctcaaaaaaaaaaaaaagatataaaaaatttagttgggtctggtggcaggtgcctgtagtcccagctactcatgaggttgaggtaggagaatcatttgagcccatatggttgaggctgcgatgagctatgatcatgccactggactcctgcctgggcagcagagccagagcctgtctcaaaaaaaaaaaaaataagtaaataaaaattaggggaaaaaaaagtcttaataactacaaaggtaactcactattttggctgagtacttcccatcattagtacccactgccagatataccatcctgaacacaagcaaggaaggttaacccctctcccccaacccaatttttattttgaaaagcttcaaacctatagaaaagttcaaatcaccattcaaatcacctagactcaccaactgttcacattttgccacatttgcctttttgctctctctccacacacacttttctgttgttggatcacttaaaaatacagatatcatgaatttttaactttaagtatttcagcatgtatttcctaagaacaaggacattctaagcgaaaataatattttttatgaactaatcaaaatttgcaattctttctataaggctgaccaagataatggaacagactccataaaactgcgattagcttgaagcattaaagttcattttcttcctctttgctgcaccccatgtgactttcttttggaatacagtttctcaacctcagcaccaatgacattttgggccagataattatttgctggggcgggggtggggtggtgtcctgtggctgcaggatgtttagcagaatccctgtccctttacccactagatgccagtatcaccctacatccagttttaacaactgaaagtgtctctatacactgctctgtgcgcggagggcaaattgcccctggtgaagaaacactgctcttaaagaataggaccccctcaatccagatgaggagtataatgataatgacaacatctattgatctactgaatgcgtggcatatggcagcatgttctaagcagtctacgtgtgttaaatcatttagcccccagaataaccatctgaaatgggtggtgtagcaccttcatcttagaggaggaaatagacacagtgagattaagcacctcatgtgaatgaacaaaccaaagaatggcttcctgcaaaaactgagatccaacactatgtatctgaaccactattcttttttttgagatggcgtctctctgtggcccaggctggagtgcagtgttgcaatcttggctcactgcaacctgtcccccgggttcaagcgatactcctgcctcagcctcccgagtaactgggattacaggagcctaccaccgcacccagctaatttttgtatttttagtagagacggggttttgccatcttggccaggctggtcttgaactcctcaccttgtgatccacccgccttggcctcccaaagtgctgagattacaggtgtgagccactgagcccgacctgaaccaccattcctgaagtaaaaggtaactttgatggtacatactgcacttaaaaaggaaaaaagttcatatgtgaagttaataaaaggatgtaggaaaacaggcactctcatatattgctaatgattgttcacactgatacaaattgctaaactcccctccaggaaggaatcatctgacttaaaaatgtgtatacccttcgacccaacaattcatcctaagaaaataaccagttatacacataaaacagaggtgcagtgatatttactacagtcttttccataacaccgaaaaattgaaactctatcaacacccaaatacagagttaaatgacaatactttcatacaatgtaattctatatagccattacaaataatagagcacatcaaaagatgttcgtgatatgttaaagtaagtaaattataaagtagaatgaacggcataatcctagcaactataacacatagaagcaaaaatgttaaatgtgattatctccaaatatgagattctagtagtgttgttttcctttagcatatctgcattttcctttttttccacccctgttttagtttggcttttatttaaaagtcgttttgttttttttaatttattttttgactgcttttgcggagcaggctatcctataagcagtatgctgagagtagcgtattcagaagtttttaaaatggaagttcagatacaaatgaaaaggagatccctttgacactgacagaattaacatatagtttcaactacttgtactcaattccaaagacccatagtatgttacaaaaatgtgtggttcctattgctgaacacattgtgaatggcacaccacagaatgggtaggaaaaagtttcttggttagtcaccagggccggtcagttgtctagcctccacaccttaacccagctgagatgctgcgggatgaactctacaggtgatctaaagtgaatcccagagatgtctaggaaactgaccccgattgtggttccagagcactgagttcaggaatgtactcggcctagactaaaacagcctagaaaggctgaagctgatgaatgaataatttgttatgtctgatcctgattctgtcacactctgcgaccatactgtgtggcttaactccaggactaatgagggcacctggcaggcgaggcattctttagtgcatatctagttatgactggacctagagggacccagaaggtgacaggtacattttcaggctatcatccacaactgttcaccctttggagaaattttatttaacttggaaacatggcccatctctatcattaacctgtctgcactgacttttttttcttttcattctttagataagcaaattatttaatttttacccaaatggtatctctgtctggtctttccatcaatccacacccaacatcatcctttgtcattaaaacagttgtgtagttctctactccactaaataaactacggaaacatgcaatgtttttcaaaaagtggttttggaacctctgaggcctcatgaagtcctcaggaggtttgaatacagagtgctatgttttagcccatccacagttggtaccttcatctatcactctggagtgctgccctggtacaagaaaatatcaagtgcctgcccctgaaagcacacgcccactcctatgaaggactgcattggtactacagtcttttcctgccatcctgtacctctggtaagatgaattgttccacgggcttgtaccacagcttgttcacctgcacaccacagcttggaggactgaagcgagcaatgaagagggcctcctacaaattgggagaaaaagacaagaaaaaatacttcatgttatacattgcatatgcaaaaagttttcaaacaccttacttcttggtcagctaaatccacaatggccctaaccacggtcactaacatggttctactgtggttttggcatcactgggttttctagtgcagtcatggttattaaataacgatatttaaggtaatcaaagttgtcacgaaattctcaaatgctaaacataatccacataaccttaaaaaaaaaacccaccttgaaagaaaaaatattcagggaagtgagcagtgttgttaaattaagccaacacattatagtgtcaacactcccccaaagggttaaaactaaactgaaagacacagatttttactgggaacaaaagcactcaggaaactccgttcaaaaagaatcttcagaagaaaatataaacaaaacaaaaaagggaatataaaagaggactggagccaggtgcagtggctcacgcttgtaatcccaccactttgggaggctgaggcaggcagatcacttgaggtcaggagttccagaccagcctggccaacatgtgaaactccaaatttctactaaaaatacaaaaattagctgggtgtggtggcaggcacctgtagtcccagctacttaggaggctgaagcaggagaatcgcttgaacccaggaggtggaggctgcagtgagccaagactgcaccactgcactcccgcctggaccgcagagccagactctgtctcaaaaaaaaaaaaaaaaaaaaaaaaaaaaaaaaaaaaaaaaccggactgattttcactatgtctatcgttttcttgggtcctcccatttcttccaggcaacatttcctcattctcatgcctattcttatataccaacttaaccataggggaaacttctgttaagctcttaaaaccatgcaggggttcaaaattaagcacatttcaatggattatgtctatttctttcatgaacaccagttcttagcaatgcagtataagaatagtttttgcatcgtgactacccatgaacccattagcatccatcttagactagtccttccttgaggacaaagattaactcctccctggttaaaaatatggcaactagaagttatatcgacatgatcaaaatattgtatgtctgaaccaaactacttgattgataactcgcacactataaatagttttgttttttgagacagtctcactctgtcacctaggctggagtgagtggtgcaatcacggctcactgtaatgcagcctcgacctcctgggctcaagtgatcctcccacctcaacctaccaagtagctgggactgtaagcaaatgctaccatgcctgcctattttcttaattttttgtagagatggggtctcactgtattgcctaggctggtctctaactcctgggctgaagcaatccatctgccttgccctcccaaaatgctgggattacaggcgtgagccattgcgcctggctgatagttttttttttaaactatatatactaagataaacaagtgtatcaaaaaaattcaagattaattctaatttctagataacagtgatactcagagtactgctatttcaattacctatttgatcttcagtatcaatgaaactgttaactacaatcatatatggactcctatagttgagtatacaaagctcttctcactaatcattatagctggcatcatcagtagaaatcctactcttccctctgtcttatatttatgtctataaacacatcaacaaacgagacagattatttagaggaagaacagggcaaattccaaaaaagaaatttaatctcaaatttatttgtgtatttattgatgagtctctaacattatattcattgctaataatcaacattaataatacaaacacattttaaaaaactgaacagagttctgctgccagtaatatcagaccaattctcctatagatagtaactatgaactctggatgaaacataaaaaacaatgatttgaaggcactggaattcaaacaaacaggcagaaactagagaagaatcagtacttggaagaaggaaaaggctccaaatatgcatctcctccctaccccacttcttgactctttgtctgaggatacaactctagggtaactagaaatttgaatgaaaatctgtagtctttctgcttgaaaattaagaggacagagttggggcaaacacatcaattaataaaaggcattagggggaacctcccagaaaggaaaggatcacagagagagagaaccacaaattcttcatataaactctacccaaatctgtggctgactcatgaaatacacatacaaggcagaacccaagtagcccatccaaggccagagaaactgaatagagattttagctgtttctcactgcaagtgagacaatgtttagtctgtgtccagccaatttagctgcctgctaaaacaaaaaaaaaaaatcaatactctgaggaatataataggatccagagttcctacaatgaattatttacaatatctaggatacaatgcatgagtagcatgtagtcccagctactcaagaggctgagatgggcggatagcttgagcccaggagtttaaggctgcagtgaaccacgactgtgccactgcactccagctcaggtaaaagagcgagaccctgtcaaacaacaacaaaaaaaccaaaacccaaaccaaaaaaccccccaaaatactagacataaaacagaaaaatgttacccatattttagaggaaagataataatcaataaagacagacgctgagatgactcagaataagcgtacacagattttaaagctgctgttataactatggtcaaagctgtagagaaaaatattctcaaacaatgaacacataggaaattttagagaaatagaaacagtaaaaaagaactaaatggaaactgaagcactaaaaagtataatatttaaaataaatctaaaataaaaaattcattggataggcttaacttcagatttgagatgacagaagagtcactaaacttgaatacagatgaacagaagttatctacattagaaaagagaaaaaacactgaaaaaaatgaacagtcttgtgatctgcaggacaataccaaaagatctaacatacatgtaattggaatcccaggaggaatagagagagcgagcgaagtcagaaaaggttctgaagacattaatagttgaaaatcccccaaatttggtaaaatacatacatttacagattgaagaaacatgtagcacgccctgaataaaacagacaaagaaaaagcacaccaggcctggtgcggtgcctcacgcctgtaatcccagcactttgggaggctacttgggaggctgaggcagcactctgggaggccgagaagggcagatcacttgaggtcaggagtttgacaccagcctagcccacatggcaaaatcccatctttactaaaaatacaaaaattagccaggtgtggtggcatgcacctagaatcccagctacttaggagtaataaaccaaatacaggaaaacgttaattgttgtagaatgtagttagtggctatagggtttaccgaataattccttcaagttttcttcatgtttaaaactaaaaaacagatccttcaaatacatttccatgctgctacttcacatgcactctgtgaacaaatcagatttccctacatatcgggaatagagaaacctcactggttttctgttttctgtaaaagaataacttttattccctctatatccttattacaaaaaagatttgaagcagttattagccttgtattacagacttctacagttggaagtaagaggcaataatactcacttatcctaagaatcctaaactttttttatatccattaccaacttttgaaattccctaggttttagggaattttaggttggagatttctaatctagtcaactccttctcttctagatatagcacatttattcacagataatctatccccaaaccagtcttatatcacactacagtgtatttagtcaataggggaagaaaggtgaaagtctctcaaccagagagaattatatagtcttccaatctacttactgtatgtcacaaggaaaagttgatgtttttgaaaaagaaaaaagagaaaaaacctgtacagagcagggcatacctcttgttctgcctgataaagtttgacagtgatgttcctctggaaacccacatcattggcatcgtagaacactccaagactggtaataacgatggggtagagaactcggaaactcacgctgacaactcgatcctcaggcagccccgatgaagtgtcttcggacagactgaacgcttcaatttcctgattcaaaactaagtaatgagaacaggtttatataactgaacaaatgtaatcctttgttttactagtaagaagtagtgaagtgggcttaatgccaaaacctaggtaatcatttgctatataattcacaaatggcaggaatttttaaaaaatgcttgagaaaaatggctgcttctatataaacatttttgaaatttaagaatacagttttcagccacatctaagtaagttaattatcagaactgctttaatagctttttgcataaatgtgtgcatatatatgtataaacgccacaggagatattaaatttaagtcaactggaaggcatctatttggaagggttggataaatagaaataagaaaaacagtactgactgtagtcataaataatcagtaaatttggtcttactgtgcaaattccaaaaatcctacttcttgttaggcaatttaaaatacttgtgatacatcaggcaattattacggtataaataagcaactgaagtcacttcaaataacactgaaaaactcttgctgtacagcactgataaaagataagcatatcaaacacagttttgaaccatcttctatgtaccatttcccatcacatttatatcttcactactacccttgtggttgtggcattatctccagtttacatattaagaaactgaggcccaaaattaagcaattcacctaaggtcatagaaagtggcagatccaggaatcaagtcccatttagtgattccaaagtcagtcccctttccactccctcacagctgtctaatcagtgccaaaacagttcaaataatttttcttttatttcttcttttgagacagtcacccagtcacccaggctgcagtgcagtggcatgaacatggcttattgcagtctcaacctcctttgctcaagggatcctcctgcctcagcctcctgagtagctgggaccgcaggcacacaccaccaggccttgctaattttttgtagagatgggggtctcatcatgttacccaggctggtcttgaactgcaatcctcccgcctcagcctcccaaagtgctgggattacaggcatgagccactgtgcccagccttcaaataaattttctaattaccataaatgaatcagaatacattaaataaagcagttcataggcagggaatatcagtgctactttaataatataaaaccctattttaaaagattatatcaaagttctttgtatcttttagagctgtggttttcaaattttgctgactacacaacaccatcagttaaaaatatttgtacacacacctatttacttacaaaatatatgcatatattgtggtgagtctatatattcagtattaataaagattgtattttcttattttcagataaatagaaattctaagcctgggcaacatggtgaaactctgtctctacgatacaaaaattagctgggcgtggtggcacacacctgtaatcccacctacttgggaggctgaggcacgagaattgcttgagcctgggaggaagaggctgcagtgacctgagattgtgccactgcagtgcagcctgggcaacagagcaagaccctgtctcaaaaaaaagaaattacattttcttcctatactctaggtcatttggttgcccacgtcagacttcctagaagctctttacactcagtagatattcaataaaatgggattaaagggaagtgatgactcctacctaattatagacatgaacaggagggaaaaaagggagaatacagttttttgtcatgggctgggcaagcactaactggagagtctagactacaacataatggacaacaatacaattttttctctttaagatattcagtaaataatagatatccatagtagaaacctctttattaaaagcaataagtcaattataatatagcatttttagatattttcttatctaaaagaattgtgccttgagcttcaagttacgtggacacaggaaatcccgttgcattacagtgctattaaaccttctaccacagccacagtatcacgatgattaatgcttaccatgaccttcaggtactgaaataaccataactgcctttggatcatcgaaaagataagattaggttcaatattaacttagttatatacacatttaaaaattcataacctaggtattacatatatgaaaatgttcttttaacataaagttctacttctttacttttaataaataacagcacttaagataataaaaatatggttaatttaaaagtgaagggcttctttttgttttggtttggttttcaattgtaatttgttggaggatacatcagtggataccacatcagtgacataacattctatggggtttatgatccctttaagactccagtgaggccaggcgtggtggctcacgcctataatcccagcactttgggaggctgaggggggtggatcacgtgaggtcaggagtttgagactagcctggccaatgtggtgaaaccccatctctactaaaaataagtcaggcgtggtggcgggcacctgtaattctagctactcgggagactaaggcaggagaatcgcttgaacctgggaggtggaggttacagtgagccgagatcgcgccattgcactccagtctgggtgacaagagcgaaactctgtctccaaaaaaaaaaaaaagacaagactccagtgaaagccaaaggactttctccccagcacacaattcatacataaaatttgcttacaatgttaactgaattcacagacatcctaagtaagaaacctctattttgtaatacagacctgaatatattgtccaatttatttaaaaagctgtttgaaacccagctttataaaatagcaggctctttaaaataatgttcagtaccttccaccttctaggaactattattctaaatacatcatatgtatcaacttatttcatccttatgtcaatccccatgagggagattcttttatcccaagtttacagatgataaaactgaggcagaggaggtcacacagctagaaaatggcaaagcttggattgagagccatggagactgcttataaaagtgaggtgttacttaattatacagttttaacaaaccttaaaataccagaagtcctaatcagcatatttaagacttggaagtataacctcccttagaaacacagctgaacataatgggaattgctaataaacacagacagttaaaaacttatcaacttcctaaaattggttccctggtgacacagagaacctagttaggatcagctttctttcgttgtctttgtttttgagacagggtctcgctctgtcacccaggctggagtgcagtagcggaagcagatcatagcttactgcagcctcgaactgctggacccaagcagtcctcctacctcagcctcccaagcagctggaactacaggcatgagccacaatacttggctaatgttttttttttcagacatgggagctcactatgttgcccaggctggttttgtgctcctcctcccaccgtggtgtcccaaagtgctggagcagctttctttatcctcaccagaatttttacaaacttttaattttaaggcataaataatgttacttgtgtcttacattttttactattttttcttttacagaaataaattagacaataattctaagagaaagttgattcataatatttgtttcttcaagattattataaattaactggtaaaatcagcagttttccaaaacttcaaaatttggtaattcaggatttatctaagcataaggaacttccaaacgcgtatgaatcacactgaaaaataaagtctcctggatcctaaagttccaattctgtaaagaatctctacagataccccaaggcaatctgtcaaaaatgatgaaataggctgggtatggtggctcatgcctgtaatctcagcactttgggaggctgaggcaggtggatcacaaggtcaggagttcgaggccagcctgaccaacacagtgaaaccccatctctactaaaaatacacaaattagccaggcgcagtggtggtagcctgtaatcccatctacttaagagaggctgaggcaggagaatttcttgaacctaggaggcggaggttgcagtgagctgagatagcaccactgcactccagcctggacaacagagcaagactccatctccaaaaaaaaaaaaaaaaaaaaaaaaaaagatgagacataaatttggatgacagacattttagtctattaaaaacagactccagggcatggtggctcatgcctgcaatcccagtgctttgggatgctgaggctggtggatcccttgagggtaagaattcaagatcagcccagacaagacagcgagacctcaactctacaaaaaatttaaaaaattagccagttttcgtggcatgtgcctgtagtcctagcagggtggtgaggtaggaggatcgcttgagccccggagtttgaggttatagtgagccatgactatgccactgcacgccagcctaggcgacagagcaagaccctgtctctaaaacacataataaaataaaataataaaaaataaaaacagactccatactattaagcttagcaacttttactcaacatcaagcttgtgtatggcagtcaagggaaaagatgacttacctggatttgtgatgttgagtagtttacaggaataaggatcttccctgtcttccacaggcacttcacagccatgagcacctattatgaacttcacaagcacactgagagatgtgttggcattaacatcagttactgatcttcacctcgcacatgcacgtttcctcatgcccatttcagagcttttactttgagacacaagtgtttatgaggattaattctctacctttattcttctagtcagacaaaatgggggaacaagtaaactgaaagttgctaactaccaagttacttatgcatgagtcctttattgcaatgctatattaaagcaagtatgaatatgtctggcctcgctacaagcaaatgttcatatcatttaaaagcaaactatagtaaagtcagttctcatgcccatacctaaaaacatatctatatctaaaattttcctttgctgccttcttctatttcagaaagtgttccttttgctcaagattaggtctttccatccaagaggaaatccccttctctcctagaccttgcttcactggttacccccgtaactagtgactccttccctccacattacaaacatgataaagtcctgactctaattattctcttcaccttccatccttccttgccaccacactttacactgaggtcctacaaagaaattaaaactgcagcctgtttcttacttcccactcattttataaaacaagagttttagctttaatatcaccacctccactgagattccactaatgtaaccaatgagctgctgctaaatcaatagacactcttgaactcttaccttcctggtttctctacggcttaatactgcccagctccctaaaatgctctcttcccttccttctgtggcctgctcagtcatcttcactgcctcttgttccccagcttgtccactgagagtggtattagtctagggctctgcctttgggtcttttctcaatctactcattttttttacttcctctccctaaacaatattatttattctcatggcttcaaatagcatgggaatgattcctgaattagtaactccagttgttttctttttttttgagacagagtctcgctctgtcacccaggctggaatgcaacagtgtaatcttggctctttgcagtctccacctttcaggttcaagtgattctcctgcctcagcctcctaagtggctgggattacaggcgtgtgccaccacgcctggctaatttttgtatttttagtagagacgggatttcaccatgttggccaggctggtctcgaactcttggcgtcaagtgatctgcctgccttggcctcccaaagtgctgggattacaggtgtgagccactgtgtccggacctgaattagtaactctagtttagacccatgtaaaggacctgtaaattcactggacatcttcacccagataacccacagacagctgtgtgctaaagcctgctactactggcttctgggagccaactgtcaacttttcagaaattttgtgagacggttattaaacatagcctttatttaaaattaaattatataatcttataatatatattaaaatcaaaggaaatactcaaattaatcacttaatgttttactacattttactattatgttcttgagatcatttatatttattacatctacatggtggaaatagtatatatggcatgctactgcttatctttcccccactctgtgttcagtgatgtcacattagtcacttgaattggccatagtggaaatattcacaccctagaaactggcaaataatacaaataagggtttggtttattgttttgttgactgtctagacttaagaaagtatagagaaaatgttgataatgcaaattaagcttaatgtgatgtgtctatctatagccactacagagtgaatagttaaaaaaaaaaaaaaaaagtcaaggaagatacgattccagtgttccaaaactattacctgatacagcatagaagtcactgactttattaagtgtaaagctgacatatcttagttgtcactttagtcctcacctcactgtttaacttaaaagaaagacttttgtcacaactacactcttttgttaactgcaaccataagttggtcatagataggagagtctgacaaacaacaaaagcgttctatgagaatcaactggtttcatggaatttacgataaacagtattgtataggttattatctgtcaattacaggctgtatatactttatgtcaataaaatttataataaacatgtatgtacatataagcatcatttttcccagagagccagttagtaaacctttatcagtacactactgcctgtaggaacctcaaggtcaacatatacacaactgagtttctttcccatgaaacctgctcttctcttttagtatttttgttttgattgatgattccactattctccaagtcagaacactagcaatcttcctagcctcctcctccattttctacattcaatgaccttattctctcacaaggtcacccctctgatctctgtagatcagcccctcagcagtccttgccacaacaggtctcgtccttccactcaaccctccacatgcctgttacatgtgatctgctcactgtctgcctctcacagtcatatgcttcccccctcttttctttatatacacctctctactctcctacctctcctggctgtttctctcacactgtgccacaacccttcccccaccaccacaagccctgtgctcaagttatatagaagtgttaggagtttctcaaacaccccgggctattttatatctatttatatcacagcacatacaacattttattatacgattacacctatttccttctactaaatgtcaagcccctcctaacactctatttatctctgtattctaccacacatactacattatttgcttacagaagtacttagtgttgagtttgggtcctttggtgaaatgcaagaatggaaaatatgccataaccacagaaatgcagtttctgttactaattaccaattaaggcagaatacctttcatagataactagcatttggaataaaagtataaacagaaatgaataaatgtgctaactaaattattgcaagtatgtaccaaatttggttttttagccatcttactaggtactcttactagatccacaaaattactgtgtcccaggaaggtgtttctgcctaatatctatttttatacagatagctgatcattctcataacacaaatcaagcacgctaaatttaaagcaagactgttatgatggcaaataaattagtggtgaaatgtctgaatataaactatattcattacatttggttctgagtcattcattcaatagttgttgagtgccttagtctgcaccaagctaggttttaggtattgggaatacaccagtgaaaaaacctgaagccccaatgctcatgaaacctacattcaagtggagaaagacaaacaattttacaactaaatacaatacagatgccagctggtgataagtgttaccaaaaaaaaattaaagccaactaagggaagacacaaacaagataggggtgggctgctatttactatggggctgtctgctagagtgacatctaatcagagacctgaaggaagtgagtcctgaggacattagtgagagaggacgtaggaaatgcaaaggccctgaggtaggggcacttttagtgtatgaaagtacagtaaggcagccagtgtaggggaagtagatgtagataaggtcaaataccacaacaaagacttggagtttcactctgagcaagaaaggaggtcaatggaggggtatgaatagagaattgacataatttgactaattttaaaaggatcactctggctgctgtatggaaaataaaatgtagggggtcaaaggtagaagcagtaagttcagagaaggggacttctgcaataatccaggtgagacataatggcagcctagatcagatggcagtggtaaaggtggtgagaagtcagattctgggtatggtctaagcagcatctggaaggtatgctgatggattggatgtggcaggtgaaaggaaaaatcagggtaacaccaagggttttggtctgagcaactggtggaggagtcattattttctaacagggaaatactacaggaagtacagcttttggaggtggttctaatagtagtgatgattctgaggtctttcatttgctgtgtaataggctctattatcattgcaaccatgaactaaagaaacctgtcttgaaaaggaatgaaagctactatgagtaagcactactagtgacaagaaaattcacaactaggccgggcttggtggctcacgcttgtaatcccagcactttgggaggccgaggcaagcagatcacctgaggtcaggagttcgagaccagcctggccaacatggtgaaaccctgtccttactaaaaatacaaaaattagccgggcatggtggcaagtgcctgtaatcccagctacttgggaggctgaggcaggagaatcgcttgaacccaggaattggaggttgcagtgagccaagatcgtgccactgcactttagcttgagcgacagcaaaactccatctcaaaaaaaaaaaaaattcacaactgcaatttgcttgtatagctactcagtcacaaatgtgccagtgcaattcaatcctgaaagggccttctctgcttatcacctgagtcttcacatacatagaagtcaacttctatgcgtttcttcccctagtccctcactacacaatcttcagaggttgatctcattgagaacagactaaggctttgggcccctaactaataactgagagctatctaatgtcagcatgaaatggattaccaaagctcagttccagaagggtagtcaggaaaaagagcatggcatattacacatactgcagattacacaactaaaaaatactacaaaactgaaaaaaattaaatttatctctgtgaagttagtgaaaagtatatttagacatgcacatgtgtctaaggagagaactgctctagaacagaaccttttaagaattgctattctaaatcaaagcaaaaaacaaacaaaccacactgggtatctaaatactacacatgttaaccagtgaatatactctcttccaattatcatttggcttaaaatgttggttaaatttactttttggcccaaactatatggaagaaaagcaaatgaaacagccatttctcccaggaagagcccacatatctgaatgaacatttctattcaaagtaaggtttttcagaacttttttttttttttaaattaggcagggactcattcccatcatgcaggctagaatgcagtggtgcaatcatggctcactgcagcctcaattttccaagctcaagcaatccttccacctcagcctccccggtagctgggacgacgggcacacaccaccacgcctggctaggtttttcagaactcttatttcaataaaccaggcaaggcaacaactcagaaaacctaccgttgacttaatgtgggatgctgtagcaaatgtctcatccaggtgcttcttatcacgtttcgaagttcatggttattgcgagctgacaacacgccaactaccacatcatagtgagtagatttccactgaggaaataaggccaactgatctagaaataagaacaatacatgagaaataagtcatgtatcaattactatgaagttcaatatgtatcataagtttattacaaaataagcttatgtttgtaggaaattcagataaacacaaagaaaagaatttttaaatcacatatgaacccactatccagagacaaccactaataacattttggtttagagtatttttgtctttcacgtatatatgtatgtattcatgctcacgtaagtatactaattcttcaaaacaaacaagatgtggtaagaatctgtttcaaaaggcaacgtagcataaaaaaatagtaggcattaagagtcaattaggccacagttagaatccaggctctatcatatattaactataagttatttagcttcttgagcctcagtttcctcaactacaaaatgggtataataatacttctcataaagctgttgtaaaaattaaatgagataacatgtataaagctcttggtttggtattaggcatatatgaggcattcaatggcaactaaaaaaaatgtgctttgaaaagtgaggtcctacattaatgttagttattaagtttggcggatgacgctgaaggacttccataccggaaagtaatgcaacccttatttatatcaatgaattctatagccagtaaacctttcactacctacaaaatattctgaagaatgacgggaaagcaacacttttagtaaaaaaaaaaaataataataataaagtaagtcattctgaacggctcattttttactgtcagaaggtctaatgggcagggttacatttccatgtaaaacttgtccttagaagacagaagagaaagatatactttgtccttgtttttcatcaccagttttaaggcttgagagctacaagcttatatatagctctgatgaggtatccatttcatctctttctccagtggtgggaactgatccaaaacgtttccaaaaataaattattgaagcccagactctttactatattaaatgcaatgtttttatataccatgggatctaggtattcagtctaaaagacaacaaaaccaggttgatattttcttcaaaggcccaattaaaataataaaaacagatctttctactaggatagttttaaggatataatacagaaatttttgtgtagataccttattttccacaatagatatatttcttaaaatgtttcattctgggccaggcacggtggctcatgcctgtaatcccagcactttggaaggccgaggtgggcggatcacctgaggtcgggagttcaagaccagcctgaccaacatggagaaaccctgtctctactaaaaatacaaaattagccgggtgtggtggtgcttgcctgttatcccagctacttgggaggctgaggcaggagaatctcttgaacccgggaggtggaggttggggtgagccgagaccgcgccattgcactccagcctgggcaacaagagtgagactccacctgaaaaaaaaaaaaaagttccattccaaatggaatagaggtatttattatttcactctacaatgagtcatgtactaaaacgaattcttttataaagacaatttatttttaaataaattcaaattttcatggattaagcttattaataggccatatttattgaacagttaatctgtgaaaagcactacatatagagtatcatttaatgttcacaaccctatgaggtaggtacttgtttctttttttttttttttttgacggagtcccactctgtggcccagtctggagtgcagtggcggcgctctcggctcactgcaacctctgccgcccgggttcaagtgattctcctgcctcagcctcctgagtagctgggattataggcgcctgtcactgtgcctggctaatttttgtagttttagtagagatggagtttcaccatcttggccaggctggtgttgaactcttgaccttgtgatccaccgcctcggcctcccaaagtgctgggattacaggcgtgatccaccgtgcctggcccagtacttgttgaacaaatgaaacacccaaagaattcagtaacttaagtcaaacagcttggaaatggctgggctaagatttaatcccaggcaatctaacaccattctttatcactgttctattctaaagctatacagcttaatatagcttatctgagtctaaattctgatcttttaatccacaataccagttcaactgaattagcaataagcggatcattgaatacgctgggtaacacatcaattttttttaactcatagctcagaacattttttctcagatacataactatatgatggaagttgtacctagtgctggaactcactctaaatgagtgtctgaattcagagactaatttaaatgactatgtaaaactgacaatatgcctccccacctttttcacagagaaatatgtacattctagtgtcaggaaggaggcaaaacaaaggtagtgaccagccagttctgacattgattccacagccaagattttgcattacgttagtaagaaattatttaaatccctgtgcttcaacttcttaattagagaaaactgatacaaaaaaaattttggatattctatttcatttgtttcaaagtctcatctcaaaagattaaaagctgtagggcaaaaatcacatttaatctaaatgcctcatttatctgacatcatcagaaaataaggatgctgcacaaaagcaaactttcaaaatatttgaaacatcacttttaattccaataatttactaccttatttttgatggctaatcaaagcaaatcttttagaaatagattacatagaacataatttaatcttttcttgatgtctcaaaatcttcatgaaaatttctcaaatctatccctttcttgtcattaattctagctgctgctcagttcggtctgttttttcacctggaccagtacgagggcatcctaactggtttttacctgacttctccatataattgtcaaacaagatttttctaaaaataataaagaaatacaaagataaccatgtgacatgtgaaaatcccatggattatggatggaaacctctttttgatcttattccacctctctgccactctcaatcccccctgcttctaatccatgtctaagctgcttctgttcaactgctttactttacatgcatttctctttttcttgcagagggaaagtaacacggcatatcgtggtcttttagagaactacttcaagatatattgaagtcaaatgtcagaaaaataggttttttaaccacataccattaatgtaaattagtccaatagactcctgagtactgtgttacacagtacaaaacccaaagcagatgcataataaaatacctatgtaagaatgttgctcaaatttctagctccctttaccaatctagctctaaactcttatcaccttttatgttacaagaacagggtacctagttgactccagtgtctagaaacagagggaaaaaaagaaagtggtaagaagtaaacatgatacagaaggacataaagataattcagaaaagaaaaaaggcaaatagcaagcctatgaaaacatgttcaacttcaataagaatcaagtttgaattagagcaatgagacaccagttttctcctacattcaaactgacaaatgtcttcttaaatgattgtaactaaatgatggtacttcaaggaaatgttgttagtgatttcaacaaagtggctactctccgccgggcacggtggctcatgcctataatcccagcttcaattttgggaggccgaggagggcagatcacaaggtcagaagttcgagaccagcctggccaatatggtgaaacctcatctctattaaaaatacaacaaaaattagctaggtgtggtggtgcatgcctgtaatcccagctactcgggaggctgagtcaggagacttgcttgaacctgggaggcagaggttgcagtcagccaagatcccgccactgctctccagtctgggtgacagagctagactccttctcaaaaaaaaaaaaaaaaaaaaaaggctactctttttcattgcgggaaggaatgtaatttggtacagtcttctgcagggcaatttggcaatgtgtcaaataatttagaatggtgtaactttgtccagcaattctaagaactcattctaaagaaataatcagtgatacactcagaagatctttattaatcatagtgtcacctattaatagcgaaaaactgcaagctacataaacacataaaggactcattaaataaattatggtgtagctatatgacagaatactatgcagccattaaaattacatgttaatcatatcattaaacattattctattaatacatcatattaagataaacaggcgataggaactatgtagatactagacggttctgtttatataaagtacaaaagtagccaaatttctgccactggttactatccctggtagtgacaaaacagagcatgaagggaacttctgaagcactgatagttttctttttttaaatctgggtggtgattagttgggtgtgttcaatttgtgaaaatacatcaaactgcgccagttttattctcttgatttattcactcaaatgacagagcatctcctatgctcattgttctagatggcacagatacagcagtaaacaaaatcttcataatgtcaggactaaatcacaatcccaagcaagctccctgagggcaacgtaagggccaagggaaagttttccctctgaaggttcggtgaaaatcactgacaagagatggacaggagaaaaggcatataaatttatttgatcagtaaagatacaggagaaagtgcccatttctgtgcttaggtttaacaaagtatagatagctatgtggaattaagattggacagaaagggtaggatctaatgttaacagatggagttggaaaacccagcaaggcctgtctagattcttcttgtcctctctgagtatacattctttcctactgggtatgggataggaccctctctggtatgaggttcttatgacctgtaataaaagaaggtaagttaggtaatttttatatagaaaggtggtggtgggggctagttagagtaatatgtttaggttttatggctggctttggggaagagggattttagtttctacagctagcctcaggtgagaatgcaaggccagagagaggacagcagcagcaggtcagagacagctgcttctgaggccttattttggggtattgttttcttctgagaccctacagtaagaactatttcttttcttaatatgtaatatatcctgagagtctggcaacctgctcaaccctgcactgtgagtggacatccaaaggtatattaaagtctaagggagggcctggcgcagtggctcatgcctgtaatcctagcactttgggaggccgaggtgaatgaatcgcttgaggtcaggagttcgagaccagcctggccaacatggcaaaacgcagtctctactaataatacaaaaattagctgggcgtggtggcacacacatgtaacagaggctgaggcaggagaatggcttcaacccggaggcagaggttgcagttagtcaagatggtgccactgcactccagcctgggcgacagagtgaaactgtgcctcaaaataataatcaaaaaagtctaaagaaggttgacatcaaaattgattgctcaaaataagcccaagagtcttaaaaatcagaccaaaattccactctgatatgcatgctcttggaagagtcacaaatagatacaaatcttgaaaatgaagaaaacatgtgagcctgtcacagatctaatgataaagacaatcatcatacacactaccaaagacacctcccaaaacaccacactagcacaggcatcagcggccaccagactaccactcctctctcaaactcatggagtgtttactatgaaacaggcactgttgcgggtgtttcattaattgaatcttcacaataagtctatgagatcatcatcttataaataaggaaactgaagcacagagacacaattagcatatagggataattttggaagaactcaccccaggcaaaattacaaagcaagctcaatttgttttctgaccttctacttgctctacatctgtttccattagatactgtgagcaccttgggagaagggactaggcatccagcacagaatctaacactcaagtacttgttgagtgaatatgctcctttgttttggtttctttctttccagataccctagaaagcgaagccttcttttgtcacatcatttttctaaattaaccgttaaataattcctacttaaggcattacccaaaacgagcattttgtaatcaagatatcctatgtttagattccttagtccgatggttatctccacctgcattttcctctgtcaccctcaggtgtactggatttcacttcctctttaccagttgctttccctgactggtttaagggaacctatcacattaaaaaagttgctgattctggtactaaggtgactcacttacttcattctggtccctgctcaactgttacctcttcagaatggaatggacttccctgacctatttaaaaccatctctttaatctcttaacactgctttatcttttttccctatacttatcactaccgctgtgatatttataattatttcctgatgctctgtcttcccttctaaattgtaaactacatgagggcaggaagtttagcttgattactgctgtaattccacacctacgataggagctggcacagagtaggctctcaaatatttgctgaatcaactgcgagccaaagaaccttttttaatattcagggaaggtaaatcgctctttcaaaaaaaacaaagaaactgccattacttaatgagactgaagacagacaaagcagcagaagaggaaaaaaaatacatttaaaaatgttaattcaagaaaagaatacttagcaaaatcttgggtttttttttctcctgttaggcttaaagtacaagggttaaaatgtaaaaacacccaactattttagtttcaacatggtgacagcacaatggtaaaggaattatgggaaattttagcatttaagatgcttccactgcttttagctttgaaagtaccaaaaggaaaaaaggaaaggtaggagtcagtcttgtttaattaattaattaattattttgagatggactttcgctcttgtcacccaggctggagtgcagtggcgcaatctcgtctcactgcaacctccgcctccgaggttcaagtgattctcctgcctcagcctccttagtagctgggattacaggcatgcaccactatgcccggctaatttttgtatttttagtagagacggggtttcgccatgttggccaggctggtcttgaactcctgacctcaggtgatccacccaccacggcctcccaaagtgttgggattacaggcgtgaggcaccgcgccgggccagtcatgtttaacttagattattaaaatatcgatggttgacagctgcagcaaaccaccatggcacacgtttacctatgtaacaaacttgcacgtcctgcacacgtatcccggaacttaaaaaaaaatcccatttattatctgaccagatatacagtactcattcaaagccaaagttaattaacataactagtattgatcttcttacctacgttattaccctgttcctttctatggtctacttcttcatttccttaatctagcctggtctaactactggatggcagataaaggcatcatccttcaagtgcagtaagggagtaggaaaaacttgtctcaaactagaaaactgcctagcaagtctactaagatttcagtttgaagtctactaacatttcagtttttgtttgttttactgaaccctaaacaaccattaaggccataaacagacttaatgacgctctacaaggagattccagcagggctcactcataacaaaagagagaaacctgtaacacacaagcagctgttacaaagcattttttataaatggcgttctcttcttagttcacttcacaaaaacctaaaaaacactgagcaaaaccctgaccccatcaactggttaagtgcatagcaacactgtactttcattaaatcacttaaatagtgtttaattctattcaggtcacacaaatccttttcaaagagctagtgatctaataggaaaagagattgttaccaaaataacctcaacataatttcatataactgagactgttttgaggattgccgaatactttctacttataaggcatagagtgctgaactgcaaacactcaattctaattttaagaacttttggattagaaaacagctgttttggggagagatggtaagggaaaaaagtgccagtatagttacaaaattaagtattacataatatttaaaagagctttctaggtttctttcatgttctagggcaagcccttaaagaagaagacaagagatacagggaaagctaaagtagtgttcagggtggtggaacccactaacaaaacaatccgctgggcaccgtaagtaaagcattctattaggctgtgacgcgaaacaagaacaaaggtttcattcctacgagagattaagttttagagcaaatggacacgatcgttaaagaatttgatatttccatgtaaactgcattagcaggttatgcgatccaaactcacaggaacaactccaactctcggccatgccctatttcatgtctagatttgtttaaccgacttacatcataatccaagaatacgaactacagtatattcttacagcaaagttattccttaaaagcaaaaccgagccacctttgaaaacacgcacacacattatccacggcactaaaaccccagtcttgaccgagaaagaccaacaacttgggggggaagaaaacaacttcagagccagagctcccaaagcagaaagcgctggcggctgaagggcacacgaggttccgctcccgggcgaacgggcggcgtcggacatcactaaccaggcctggggacgggcgaaggacttgcagctgcgggcgccggctctgcgggcgttaaggcaaacggggaagtgagaagcggcggggacacgaaaagagaaaagctccctcaagtttgcccgatgttaacgctccaaggatgaaaagagccgtttgtttcgtctggggaccgtcgcgtttggcccttcccccgcctccaacaattcccggcgaagccccgcggcaccaagccgggcctcccacccccccggcggccgccaacccgcccggccccaggacctcacctgcagggccggccccggaggcgcaggcgggcggcggggagcgcagccgcagccagaggtgcagcgcggccccgagcacacacgggcacagcagcaccagccagtttcgcattggccgcccccgccgcgagccgggctctcccgcgtcccggcggagagggaggggacctgcaagtgcggagactgaggggcggcggctgacgagcgaccactccgagcacgcccgccctcgcgctcggcgacgtctggagggctcctcgcagctcccggccccgctcctccggtccctcagaccgcgggtggccgcggcttagccggccgaagccccgccccctccgcct

SEQ ID NO: 2509 - DNA, 81554 bp, Homo sapiens
cctacagcacttccggccagagcctcaagcttcgctgctgggcagttggctggaggggctgctgctgggaacacctggagtctccgcgggcaggtgagcttcagaggttcggggagctttcggaacgagcattcctggccggtgcgtcaccctgcagtgctcttggccttttcttcctttcctggaatcttcccagattgccagagccgggcgttgcctgctccgtgcgctgggaggcggtccagccggctgggttggggccaccctgcgcctcctggaaggccttatttaggagtagccgcacgtgatctctagcattttaagcttctctcagagaattggcatgtcactttggaagaggtgaaaatggtacaggcgaccaacgacttttacaaggtgtcaccttagaggaacagcctcgtccttccgaatcagttaacattggtgatgacagagaaataacgttaaataggtggagagcacttaaagtaactgtttgttcttttgagacagtcttgctctgtcgcccaggctggactgcagtggcgcggatctctgatctcggcttactgcaacctccgcctcctgggttcaagcgattctgctgcctcagcctcccgagtagctgggattacaggcgcgtgccaccacgctcggctaatttttgtatttttagtagagacagggtttctccatgttggccaggctgctctcgaactcctgatctcagatgatccacccgcctcggcctcccaaactgctgggattacaggcgtgagccaccgcgcccggcctaaagtaactatttttacttggtgtttactaccaaatggggactgttctaagttgtgggtggatccaaatgatggtgtgacagccttatcctcagagaagcagtcctggcaggaagacggggttaacaaattgccaaactgttagagaaagttagtggaggtagagatgaagagagaagacttttcttttctctggcattaatttagccacggccgctgtgttttgatacttgcttcaaacgtttttcatattcttaagttttaacttttctgtatgctcatattttatatactgttgtaaacagcatatctctgggttttttttttaatctaagtggacagcctgctttttttttttttttttttttttgatatggagtcttgctctgtcgcccaaggctggtgtgcagtggcccaatctcagctcactgcaaccacgcctcccaggttcaagcatatctcccacctcagcctcccgagtagttgggatgacaggtgtgtgccaccatgcccagctaatttttttttttttgtatttgtagtagagatggggtttcgccatgttggccagactggttttgaaggcctgacttcaggtgatccacctgcttcagcctcccaaagtgctggggctacaggtgtgagccaccgtgcccagcccagtctgccttttgactagcaggtttattggatttacattcattgtcactactgaaatatttgtctagatgaaaatctttggtatcatccctgattaatctcttccatatatatcagcaaatcctatggactctccacctttaaaatctgtccacactcccaggctcttgttatcaccttcacttgttcaagttacgttgtctcgtacttgaattactgcagtagtttctgctctttcctcttttagtctgtttgcatcacagtatctcggttgatcctttaaaaaaaaatcagatttatgtctttcctctcaaaaatcctccaaggactacacatttcacctggagtgaaagccaaagtcggccgggcgtggtggctcatgcctgtaatcccagcactttgggaggccgaggtgggtggatcacgaggtcaagaggtcgagaccatcctggccaacatggtgaaaccccgtctctactaaaaatacaaaaattagccgggcgtggtggtgcgtgcctgtaatctcagctactcaggaggctgaggcagaagaatcgcttgaacccgggagacagaggatgcagtgagccgagatcgtgccactgcactccagcctggcgatagagcaagactctgtctcaaaaaaaacaacaaaaacaaaaaaaacaaaaactggctgggcgcagtggctcaagcctgtaatcctggcactttgggaggccaagactggtggatcacctgaggtcaagtgttcaagaccagcctggccaaagtggcgaaaccccgtctctactaaaaaaaaacacaaaaaattacccaggtgtggtggtgtgtgtctgcaatcccagctattagggaggctgaggcaggagaattgcttgaacctgggggcaggcgcggaggttgcagtgagccgagattgtgccattgcactccagtctgggcaacaagggcaaaactctgtctcaaaaaaaaaaaaaaagccgaagtcttcagagtggattattcatcgaaggtcctatgtgacctagccctgcttcactgctgatctcatgtcgttctcatctcctgtttgctctactgtatggtctcctcaagcgcatcctagcctcaggatatttgcacttgctattcctttccctcatatgtccacatggctcagttctttacctctctcatattttggggacctttaccttctcagtaaggccttctctgacaagccactgccatctttaacatttccattgcactcgttatccttgtgcttatcatcatatgacatgccatgtgatagagtcatttatctggtttattatgttttctctcactggcatagaaggtttatgagggcaggtatttttctgttttgtttactgctgtattctttttttttttttttttctgagacggattcttgctctgttgcccaggctggagtgcagtggtacgttctcggctcactgcaacctctgcctcctgggttcaagcaattctctgcctcagcctcccaactagctgtgattacaggcgcatgccaccatgcctggctaatttttgtatttttagtagagatggggtttcaccatcttggccaggttggtcttgaactgctgaccttgtgattcacccgcctcagcctcccaaagtgctgggattacaggcgtgagccactgcacccggcattttttttttttttttgggaagatctcttattgtacttccctgtaaaatccattactgttttattccaattgcctaaaatagtatctggcttttagcagacactccataatataattgttgattgaatgaatttggggtttttgcaccatcttctacacttcatatttttatgcttttttcctccttgtcttttcttttttttttttttgagatggagtcttgctctgtcgctcaggctggagtgcaattgtgtgatgtcggctcactgcaacctccgcctcccgggttcaagcgattctcctgcctcagtctcctgagtagctgggattacaggcgcacgccaccacgcccagctcttttttgtatttttagtagaaatggggtttcaccatgttggtcaggttggtcttgaactcctgacctcatgatccgcccgcctcagcttcccaaagtgctgggattacaggtgtgagctatcacgcctggcttttttttttttttttttttttttttttttttttgagacagagtggttgctcttgctgcccaggctagagtgcaattgcatgatcttggctcaccgcaacctccgcctcctggcttcaagcaattctgccacctcagcctcctcagtagctgggattacaggcatgcgccaccatacctgactaattttgtatttttagtagagatggggtttctccatgttggtcaggctggtcttgaacttctgacctcaaatgatccacctgcctcagcctctcaaactgctgggattacaggcgtgagccaccgcccccggccactcttgtctttttttttttccctttttttttttttttgagacagggtctccctctgtcacccaggctgtagtgcactgacacgatcttggctcactgcaagctctacctcccgggttcaagtgattctcccacctcagcctctgagtagctgggattatacgcgtgtgccaccatagcctggctaatttttgtatttttattagagatggggtttcatcatattggttaggcttgtctcaaactcccaacctcagttgatccacccacctctgcctcccaaagtgttaggattacaggcgtgagctacagcacccggccccacctttttttctgagacagagttttgctcttgtcacccaggctggagtgcaatggcacgatctcggctcactacaacctccacttcccggattcaagtgattctcctgcctcagcctcccaagtagctgggattacagggacccgccagcatacccagctaatttttgtttttttagtagaggtgggggtttcaccatgttggccgggctggtctcgaactcctgacctcaggtgatctgcctgccttggcctcccgaagtgctgggattacaggcatgagccactgtgcctgccctttttttcattttttcatttttttgtacaatagggtctccctctgttgcccaggctggagtacagtggtgtgatcagggctcactgcagcctcgaactcctgggctcaggtcatcctccaacctaagcctcccaaatacattggcctataggcgtgcaccaccacacccagctgatttttatattttaatttttaattttgctgtgcatatttagctgggattacagacgcactccacctcgccaggctaatttttgtatttttagttgcaacgggatttcaccatagtggcaaggctgctctggaactcctgacttcagatgatcctcctgccttggcctcccaaagtgttgggattacaggcgtgagccaccgctcctggctggctttgtagaaccttaaacatatttatctatcttaagaatttttcccaaggaaatacttcataaggtaatattttaaaaatcaaagctgtttttagctgttttctttggagttgtaaataaacagcattagagaaatgattggctgggtgcagtggttcacacctataatcctagcactttggaaggctgagacgggagaatctcttgaggccagcagtttgagaccaacctgggcagcatagagagatcccttctctaccaatagaaaagagagagagagagaggctgggcacggtggctcacgtctgtaattccagcactttgggaggccgaggcgggcggatctcgaggtcaggagatcgagaccatcctggctaacatggtgaaaccacgtctctactaaaaatacaaaaaattagccgggcgtggtggtgggtgcctgtagtcccagctactggggaggctgaggcaggagaatggcgtgaacccgggaggcggagcttgcagtgagctgagattgcaccactgcactccagcctgggcgacagagtgagactccgtctaaaaaaaaaaaaaaaaaaaaaaagagagaaattattaagtaaattgtggtatcatacttggatattgagatgattaatgtgttgactctgtggctgtatagaaaaatgtttatggacaaatgttaatatggccagttgaggtagctcaaacctgtaatcccagcactttgggaatcctcaggaggattgcttgagcccaggagttaaagaccagcctggataacatagtgaggccctactttattttaaaggaagttaataaaagaagtagaacaaattatatgtctcagtggtagtaaaattctgcttacatgttaatgaaaattttgaaagggcacttaaaactagtaaaaaactcatttttagggtaatacaattgtagtaaaatttaaacatttaaattttatgatcggaagatggtagtaaatcagaaatggctttggaatttctttcattgcaaccttaatagtaagcaacagtctttcccatgaaagggacagaaaaaaaagaatgtaacgtctacatttttttttttctttgagacgcagtctcactctgtggcccagtctggagtgcaatggcacgatcttggctcactgcaacctccgcctccagggttcaagcaattcttgtgcctcagtctcccaagtaggtgggattacaggcactcaccaccatgcccggctaatttttgtatttttatttttatttatttttatttttattttattttattttatttttgagacggagtctcgctctgtcgcccaggctgaagtgcggtggcgcgatctcggctcactgcaagctccgcctcccgggttcacgccattctcctgcctcagcctcccgagtagctgggactacaagcgcccgccaccacgcctggctaatttttttgtatttttagtagagacggtgtttcaccgtgttagccaggatggtctcgatctcctgacctcgtgatcctcccgcctcggcctcccaaagtgctgggattacagacgtgagccaccgcacccagacttgtatttttattttttaaattttaaaattttatttatttttttgagactgagtctttctttgttgcccaggctggaatgcaatggcataccttggctgactgcagcctccgcctcttgggttcaagcctccagagtagctgggattacgggtgcttgccaccatgcctggctaatttttgtatttttagtagagacaggtttcaccatgttggccaggctggcctcgaactcctgacctcagataatccaccctcctcggcctcccaaagtactgggattacaggcgtgagccactttgcctagcctacactgttaaatgaatgcttttcagaccattgtaccccacgtgcaggtcaggccacatctggaatgtggcgttcagttctagatatcgcaatttaagcatggaatcagtaaatcagttacagaggaaaactggaatgctataaggagggtttaaggagctggaaatgtttaccctggtagagaggtttgggagatgaagacaggaagcagggaaagcagaaatggtaacaaatggccttccatatttatttatttattttttgagactgaatctccctctgtcgcccaggctgaagtgcagtggtgcaatctgggctcactgcaacctccgcctcctggattcaagtgattctcctgcctcagcctccctaggagctgggattacaggtatccgccaccacacctggctaatttttgtatttttagtagagacggggtttcaccatgttggccaggctggtctcgaactcctgacctcaggtgagtcacccaccttgtcctcccgaagtgctgggattacaggtgtgagctactgtgcccagctggccttccacatttaaatgttgtctgggaaagggaatatattgattctctgtagctacatagggcagtagtagaaaattactaggtgaaaatgatagagatgtagatttctttttttttcttttttttttttttttttgagatggagtctcactctgttgcccaggctggagtgcagtggtgcgatctcggctcactgcaagctccgcctcctgggttcacaccattctcctgcctcagcctcccgagtagctgggactacaggcgcccaccaccacgcccggctaattttttgtatttttagtagagatggggttttgctgtgttagccaggatggtctcaatctcctgacctcatgatccgcctgccttgtcctcccaaagtgctgggattacaggcatgagccactgtgcctggcctagagatgtagatttcatctttttaaagaagaataacaagagtcactccaacatttaagtgggctatcttcattagttagcaagtgtgtgtattttaaaaagtcattccatctgaaccaagccttagtcagcacccagatagacctaactaagagcaacatgccactcacattcaggtgattaggagagggcccagtgcaggccattacagagaacttaactaggcagcagctgactgcaggtcattttgactggatactaaaatggggctgggggtgggggagtgatcaaagtggttgtcctagcaacaggcaataagggtgcagagtgggccagtaacagcatcaagtaggtctaacatcaggaaacagggacccactggttactagctagaagaagagggtaaaggctttggaactaaggcataggtcaccaagacatggatccagtttctaggtcttcacggaagatcatggtatcaagaaagacattattagaaacgttcagagactagacaggatcatcaaaaatactgacttgaggctgggcgcagaggttcacacctgtaatcccagcactttgggaggccgagatgggtgaatcacctgaggtcaggagttcgagaccagcctgaccaataaggtgaaaccccatctctattgaaaaaaaaaatacaaaattagccgggcttggtggcacatgcctataatcccagctactctggaggctgaggcaggagaatcgcttgaacccgggcggtggaggttgcagagctgagatcacgccattgcactccaacctgggtaacagagcgagactcttctcaaaacaaacaaacaaaaacacctgacttgacacagagactgttaattactgaccttagaccttatacctaatgatctcattggtcatgtctgtgggcacagcatacaggtaggaatggaaaaaaaaaattgttactggagattaagtaggatcaagcatgtgaaggaattcatgagttacctacagatgttagattaataatgagaatggcttcctagtgtcttcaatcctcattcctgctattacactctctggttttacttcccattgatggctgcccccttcttctcaccaagccattctcactgttagcctgatctgcagggtgatgtagtagtacccttaagctgagccccagctggaaagagcctcagactgattatggggccttgtgagtttctggatttagataatccctatacagtctagttcatggagccaagatttggcctagtactttaatttcttgtaggagtggagttctgcagtcattttattcgtccctcttcttagggactagagctctgaatctgagcacaggtttttgggtagtgctgtgtctctggccagacctcttagcttactaaaacataaattccccatgcctggtctgacccgtatgttgatcctgccatcacatcatctaaactggccggcacagtggctcacacctgtaatcccagcacttggaggccgaggtgggaagatcacttgaggtcaggagtttgagaccagcctggcccacatggtgaaatcccgtctctactaaaaatacaaaaattagctgggcctggtggcggccgcctgtaatcccagttactcaggagggtgaggcggaagaatcgcttgaacccgggagatggaggttgcagtgagctgagattgcaccagcctgagcgacagagtgagactccgtctcaattaaaaaaaaaaaatcatctaaactgctttgacttttctcaccaactttgggctcggagattatttctcttttgcttttcaacactactgggcatgtttagatctggatcctggcccccttcccaatggccctgtcctcctttatttaaatagacaaaattcagctccattttgaaagtaggattcttttcacaacaattgggaaaaatgattttttttgttttgttttttgtgagatggaattttgctctgtcgccaggctggagtgcagtggcacgatcttggctcactgcaacctctgcctcccgcattcaagtgattctcctgcctcagatggccaagtagctgggactacaggcgcgcactacatgcccaactaatttttttgtatttttagtagagacagggttttaccctgttggctgggatggtatcgatctcttgaccttgtgatctgcctgccttggcctcccaaaatgctgggattgcaggcgtgagccaccgcgcccagcctaatgttattgtttttacaaaatatttgaggagctgattgagaggaccttatgcagaaacttaataaacttaaaatcatataatgtgagattgaaatgcttagattattctgtaatatggaaatagcaggtctaatgtaacagacaactccagtaacagaggaaatgtctacctattctttttttttttttgagatggggtcttgctctgtcacccaggcagaagtacaatggctcgatctcggctcattgcaacctctgcctcccgggttcaagcgattctcctgcctcagcctcctgagtagctgggattacaggcatcgcgccaccacgcctggctagtttttgtatttttagtagagacggggtttcaccatggtggtcaggctggtctcgaactcctgaccttgtgatccacccgcctcggcctctcaaagtgctgggattacagacatgagccaccactccccttccatctacctgttcttaaaataaaaaaaacccataaaggtggagaggtaataataacaaaggcctcagatatctatataccaatggagtttgtgggtagtcagtaatgtattctaaccccagatggcatgtaacagcatatgttttttcttttgttttgtacacatattatatatgataatattaaaatagaaaaatactttgttcaatagttatgtaacttgtcgtttaaaaatccttgtacttcaacactgttatcttttatttgtgtttttttgtttgtttgttttgagacaggctctagctctgttgcctaggctggagcagagtggcatgatcttggcttactgcagcctcagtcttctgggctcacatgatcctcccacttcagcttcccaagtagctgggactacaggcgtgtgccacaatgcctggctaatttttgtatttttttttggtagagataagtttcactatgttgcccaggctggtctcgaattcctggcctcaggtgatctgcctgccttggcctcccaaagcgctgagattacaggcatgagcaaccgtgcccagccaacactgctagctttttaaaacagaaagtgagttttatttaggccggccgcggtggctgatgcttgtaattccagcattttgggagactgaggtgagtggatcacttgaggtcaggagttcaagaccagcctggccaacatggtgaaacaccatctctactaaaaattcaaaaattagctgggtatggtggcgtgtgcgtggtggcgtgtgcctgtaatcccagttactagggaggctgtggcaggagaattgcttgaacccagcaggcagaggttgcagttagcagagatcgtgccactgcactccagcctgggcaacagagcgagactctgtctcaagaaaagaaaaaaagaaagtgagttttatttagacaaagatgaaggtttggaaattaaccatatttgtgcttgcaaaaggggcacggatttttaagccctagtctcacaggctctctctgcagcatctgatactgttgcttgattattcctgctttaaactctgtcccttggattccaaggcatcaggtagctgctcttcttttttcttttctgttttttctttctccgacttcttagggatttcttctttcttaactattatgtttttgcaggattctgtcattgatccccttttctttctagctgataccctttcattctcatctactttcatgctatcagttataagctctgtgctgacaacccctaaaaacatgtttctaggccgggcgcagtggctcatgcctgtaatcccagcactttgggaggcagaggagggtggatcacctgagatcagaagtttgagaccagtctggccaacatggtgaaaccccgtctatactaaaaatacaaaacaattaaacagcatggtggtgggtgctgtaatcccagctacttgggaggctgaggcaggggaattgcttgaaccagggaggtggaggttgcagtgagccgagatcgtgccacagcactccagcctgggcaacagagtgagacaccatcttaaaaaacaacaacaagaacaaaaaaaacacatttctagcgcaaatgtatcgtttgagctagagacccacatccgtcatcaccctctataggcactttaagtatactgacttctctcccaaacttgaaccttctcttataggccaggcgcggtggctcacacctgtaattttaccactttgggagactgaggttggtggattgctggagctcaggagttggagaccagcctgggcaatgtagcaaaaccccttctctactgaaaatacaaaaattggctgggtgtggtgaagcacatctgtggacccggttactctggtggctgaggcacaagaacccttgagcctggaaggtgggggttgcagtgagccgagattgcgccactgcactccagcctgggcgacagagcaagactgtgcctcaaaaaaaaaaaaaaaaattcctttaaaggaattgtattaagttcttatcagtgttgtatttttcttcctagatctcatattttggattctggatatattataatgagtgacactttgacagcggatgtcattggtcgaagagttgaagttaatggagaacatgcaacagtacgttttgctggtgttgtccctcccgtggcaggtaagcaattattgtgtgtgtgtgtgtgtgtgtgtgtgtgtgtgtgtgtgtgtgtgtgtgtgtgtattttgcagctgtttctgtgtaagcttctcagtagcactttataccacaaattttgacgaaattaacaactaatttataggtgcctcctgtatccagttttatctgagtgacagtatcctgtggtatctatgattttgtttaattatatgccatttaattatttagtgttgctatcttatataaaatcaaccttaaaatatcttctgaggaaactataaacagctaaaagtcttgaaacctcataaacctcaactcaagtaatttttttgaaatttcttttgtcattaatccacgtgtgtaggtatctaatatagtttaaactgatacacattacaatttttgttaccttttttttaaacttattttttggtataaatttacctatgtttctacagcattattttgcaatatttcttctttttttgattttgcgtatttcttaattattacatttagtataatatatagtttgtttaattgttccccatttttggatgttaatttctagtttttagagtaaataataatgtagtagacttactcataagtcttagtcaacaaaaatttgactgttttctgtgtattttgagacagagtttcgctcttgttattcaggctggagtgtagtggtgcgatgttggctcaccgcaacctctgcctcctgggttcaagcgattctcctgcctcagtctctcgagtagctgggatttcaggcatgtgccaccacacccgactaattttgaatttttaggggagacagggtttctccatgttggtcaggctggtctcgaactcctgaggtgttctgcctgcctcggcctcccaaagtgctgggattacaggtgtgagccaccgtgcctggccaataaggaggctttctatgaactgggcaactgctggaaccaagctgatatgggtttactagctgattgcaatgtgcccagaattagaatatttatccatatttttacattacccatccctcttgtttcttctgagctgcagccagagatcaccagttggttcacaggaataagcagggttagcctaaattgaagaaacaaacttaaaaacaactaatgagactagaatctaatgacaaatgccccatagttcttgaaacataatttttctctctagtttccaagttttactaaagacaagtcatggtaagactgatttgcttgggccgggcacggtggctcacacctgtattcccagcactttgagaggccaaggcgggcggatcacaaggtcatgagattgagaccatcctggctaacacggtgaaaccccatctccagtaaaaatccaaaaaattagccggatgtggtggcgggcacctgtagttccagctactaagggagactgaggcaggagaatggcatgaacctgggaggtggaggttgcagtgagccgagaccacgccactgcaccccagcctgggcgacagagcgagactccttctccaaaaaaaaaaaaaaaaaaaaaaaaaaagactgatttgctttattgtaattggcctgattatttgtataaagtgcagcaagaataattatttttcttttttttctttttttaattttttaattgtatttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtcctcagagtgtgatgttcaccttcctgtgtccatgtgttctcattgttcagttcccacctatgagtgagaacatgcagtgtttggttttttgtccttgtgatagtttactgagaatgatgatttccaatttcatccatgtccctataaaggacatgaactcatcattttttatggctgcatagtattccatggtgtatatgtgccacattttcttaatccagtctatcattgttggacatttgggttggttccaagtctttgctattgtgaatagtgtcacaataaacatacgtgtgcatgtgtctttatagcagcatgatttgtagtcctttgggtatatacccagtaatgggatggctgggtcaaatggtatttctagttctagatccccaaggaatcgccacactgacttccacaatggttgaactagttgacagtcccaccaacagtgtaaaagtgttcctatttctccacatcctctccagcacctgttgtttcctgactttttaatgattgccattctaactgatgtgagatggtatctcattgaggttttgatttgcatttctctgatggccagtgatggtgagcattttttcatgtgttttttggctgcataaatgtcttcttttgagaagtgtctgttcatgtccttcgcccactttttgatggggctgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtcctggcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacatggcgatgcgggctcttttttggttctatatgaactttaaagtagttttttccaattctgtgaagaaagtcattggtagcttgatggggatggcattgaatctgtaaattaccttaggcagtatggccattttcacgatattaattcttcctacccatgagcatggaatgttcttccatttgtttgtatcctcttttatttcattgagcagtggtttgtagttctccttgaagaggtccttcatgtcccttgtaagttggattcctaggtattttattctctttgaagcaattgtgaatgggatttcactcatgatttggctctctgtttgtctgttattggtgtataagaatgcttgtgatttttgtacattgattttgtaacctgagactttgctgaagttgcttatcagcttaaggagattttgggctgagacagtggggttttctagatatacaatcatgtcatctgcaaatagggataatttgacttcctcttttcctaattgaataccctttgtttccttctcctgcctaattgccctggccagaacttccaacactatgttgaataggagtggtgagagagggcatccctgtcttgtgccagttttcaaagggaatgcttccagtttttgtccattcagtatgatattggctgtgggtttatcatagatagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtacctgttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttctttttattagtcttgctagcggtctatcaattttgttgatcctttcaaaaaaccagctcctggattcattagatttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgttgtcccagagattctggtatgttgtgtctttgttctcgttggtttcaaagaacatctttatttctgtcttcatttcattatgtacccagtagtcattcaggagcaggttgttcagtttccatgtagttgagcggttttgagtgagtttcttaatcctgaattctagtttgattgcactgtggtctgagagacagtttgttataatgtctgatcttttacatttgctgaggagagctttacttccaactatgtggtcaattttggaataggtgtggtgtggtgctgaaaaaaatgtatattctgttgatttggggtggagagttctgtagatgtctattacgtccgcttggtgcagagctgagttcaattcctggctatccttgttaactttctgtctcgttgatctgtctaatgttgacagtggggtgttaaagtctcccattatcattgtgtgggagtctaagtctctttgtaggtcactgaggacttgctttatgaatctgggtgctcctgtattgggtgcatatatatttaggatagttagctcttcttgttgaattgatccctttatcattatgtaatggccttctttgtgtcttttgatctttgttggtttaaagtctgttttatcagagactaggattgcaacccctgcctttttttgttttccatttgcttggtagatcttcctctatctttttattttgggcctgtgtgtgtctctgcctgtgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctgtttattttgctcgttagttgatgcagtttcttccagccttgatggtctttacaatttggcatgattttgcagtggctggtaccagttgttcctttccatgtttagtgcttccttcaggagctcttttagggcaggcctggtggtgacaaaatctctcagtatttgcttgtctgtaaagtattttatttctccttcacttatgaagcttagtttggctggatatgaaattctgggttgaaaattcttttctttaagaatgttgaatattggctcccactctcttctggcttgtagagtttctgccaagagatccgctgttagtctgatgggcttccctttgtctctggctgcccttaacattttttccttcatttcaactttggtgaatctgacaattatgtgtcttggagttgctcttctcgaggagtatctttgtggcattctctgtattttctgaatctgattgttggcttgccttgctagattggggaagttctcctggataatatcctgcagagtgttttccaacttggttccattctccccgtcactttcaggtacaccaatcagacgtagatttggttttttcacatagtcccatatttcttggaggctttgttcatttctttttattcttttttctctaaacttcccttctcgcttcatttcattcatttcatcttccatcactgataccctttcttccagttgattgcatcagctcctgaggcttctgcattcttcacgtagttcttgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaatttgtcaaagtcattctctgtccagctttgttccgttgctggtgaggagctgtgttcctttggaggaggagaggcgctctgctttttagagtttccagtttttctgctctgttttttccccatctttgtggttttatctacttttggtctttgatgatggtgatgtacagatgggtttttggtgtggatgtccttcctgtttgttagttttccttctaacagacaggaccctcagctgcaggtctgttggagtttgctagaggtccactccagaccgtttgcctgggtatcagcagcagtggctgcagaacagcggattttcgtgaaccgcgaatgctgctgtctgatcgttcctctggaagttttgtctcagaggagtacccggccgtgtgaggtgtcagtctgcccctgctgggggtgcctcccagttaggctgctcaggggtcaggggtcagggacccacttgaggaggcagtctgcctgttctcagatctccagctgcatgctgggagaaccactgctctcttcaaagctgtcagacggggacatttaagtctgcagaggttactgctgcctttttgtttgtctgtgccctgcccccagaggtggagcctacagaggcaggcaggcctccttgagatgtggtgggctccacccagttcgagcttcccggctgctttgtttacctaagcaagcctgggcaatggtgggcacccctcccccagccgcgctgctgccttgcagtttgatctcagactgctgtgctagcaatcagtgagactccgtaggtgtaggaccctccgagccaggtgcgggatataatctcctggtgtgccgttttttaagctcatcagaaaagtgcagtattagggtgggagtgacccgattttccaggtgccatctgtcacccctttctttgactagcaaagggaactccctgaccccttgcgcttcccaaatgagggaaagatgttacaggaaatggtctcaatccagaccccaaaagagggttcttggatctcgtgcaagaaagaattcagggccagtctgtaaagtgaaaacaagtttattaggaaagtaaaggaataaaagaatggctactccatagacagagcagcccctccaggggattctgatgcacaataaggtttggtgaaagccattgaacaagatacatgtggactctgccttcatggaggctgtggaagtctttaacatatacctaatctgtcaagggtttttactttcctggtattatttgtaaatgggaagagaaagtaatgtttaatgaataattactgtgtaccagacacttgaaagcatgctctcaactttgaatattccaataacaaccttaaaatatagatgttactattcctatgtttatagacaagaagaccaagtctcaggtcttaaaacttttatatagcagagctgggatttgaatctatccttcattgcccatgccctttcttctctgttacttcttttttttttttttttttttttgagatggagtctcacttttgttgcccaggctggagtgcaatggcatgatcttggctcactgcaacctccgcctcccaggttcaagtgattctcctgcctcagcctcccgagtagctgggattacggggacccaccaccacacccagctaatttttgtatttttagtagaggcagggtttcaccatgttggccaggctggtctcgaactcctgaccttaggtgatctgcctgcccaagcctcccaaagtgctgggattacgggcatgagccactgcacctggctctactctgttacttctaaggaatgtgaatattctcaggttcttgacatatgttgccaaattgttgtctgcaagtcagtcaatgtccggtacttggaaatttccaatattcacattctctgggaagcagacttagctagagatttacacttagaaagtttagtgttcagaaagttttttagggagtactttgggaccagtactcatggaagaggaaagagagtaagcaaggttgggcagagggctaagctgggctatggtacagcctcaacaaatatttcagctgtctcctttgggtgctctgaagatagagtggcctttcagagtctttcctagtggagatgaggggctgggtcattatacattagtgatgatctgtcactaggttctgttgaccctaggaagggggtgtgcccttgggcaagatgctttctacagtagacagttccataagagggcagacagttgagggctatttaccaaaagccagtcctcccagctattgggagataagtcccaattcttgaagacagggtggcatatcactagtacagtaatatagataaaagttttttaatgatagtttagcaaacgtgaagtttttaatttatttaaattttatttattaaattgcctgtgaatgtgacactttcttcatgcatgttttatcaggtaagtgcttctttctcccttgaaaattgtaattctgcagagagggagctactgtaaatttaagctttttgtttgtttgtttgtttgaggttgagtttcgttcttgttgcctaggctggagtgcaatggcacaatctcggctcattgtaacctctgcctcctgggttcaagtgattctcctgcctcagcctcccgagtagctgggactacaggcacctgccaccacacacagctaatttttgcatggtttttttggtagaaacggggtttcaccatgttggccaggctggtctcaaacacctgacctcataatctgcccatctctacctcccaaagtgctgggattacaggtgtgagccaccacgcctggcctgcatttagtttagaggtcatcttttggaattggtactaagatgcacagaaattgaacacagatttagtaataatttctgcggttacttcactggatgttgtagagctgttatgacaactaaatcagttagatgtttaaagcacttagaccagttaatcgtgcatattgttgtaaataaacattttaaaacttactttaaaaagaaatgcagactgggcgtggtggctcatgcctgtaatcccagcacttcaggaagccaaggctgtagatcacttgaagtcaggagtttgagaccagcctgaccaacatgttgaaaccctgtctctactaaaaatacaaaaaaaattagctgggttttgtggtgcgctcctgtagccccagctacttgggaggctgagacagcagaatcgcttgaacacgggaggaagaggttgcagtgagacgaaatggcatcactccattccagcctgggtgacagagtaagactgtctcaaaaaaaaaaagaaaaagaaaaagaaatgcaattgtactaatgttctgcaaatggcttcttgtaattggagatattatttcctgtgatagcatcatacaaagatttaaaaagtattacatcttaaactgttcagatggaataaagatgatatactgtggtgggcaggataatagcctcccaaagatgtccccagaacctctgattttgctaggttacatggcaaaggggaattagaattatagatggaattaaggttgctaatcagctgattttaagattgggagagtatccggtttatccagttgggctcagtgtaatcacaagaatcattagaagtagaagctaggctagacgcagtggctcacacctgtagtcccagcactttgggaggccaagtcggatggatcacctgaggtcaggagttcaagaccagcctgaccaacatggtgaaaccctgtctctactaaaaatacaaaaaatacaaaaattagtcagatgtggtggtgcatgccaataatccgagctacttgggaggctgaggcaggagaatcgcttgaacctgggagacggaggttgcagtgagctgagatcgtgccattgcactccagcctgggtgacaagagcgaaacgtctcaaaaaaaaaaaaaaaaaaaagtagaagctagaggcagaagaggcagtgtcagtgtgacgtgagaatgtttcagctggccattgtttattctgaagatggaagagggtcatgagctaaggagtgtgcagcctctaagcctctagaagctggaaaaactttcctcatatgataaggaagctatcatgtaaaggttcatcttacatttcttgctgttttctttctttcttttgctggcaaatatcattcaggggccacagtatgggctgcagcggtgttcattgctactgggttggtcttcgtttctgggcctttttaaaggacagagctgcctctgttggattaattcctacaagtagaatagatttaaggaagatatgagtagtttttatattattattagaaaatacaaaaaagaaaaggtttcaaaaatatagaaagtagagagaataagccaggcgtggtggctcacgcctgtaatcccaacactttgggaggcaggtggatcacttggtcaagagttcgagaccagcctgggcaacatggcgaaaccctgtctctactaacagtacaaaaaaaattagctgggtgtggtagtgggtgcctgtaatcccagctacttgtgaggctgaggcaagataattgcttaaacctgggacgtggaggttgcagtgagccgagattgcaccactgcaccccagcctgggccacaaagactccatctcaaaaaaaaaaaagcgtagacaaagaaagtagagagaatagtataatggacacctgtatatgcttgtcatgtcagtttaacaattgttaacatgttaccataccatatttgcttcatttccttttttttttttttttttttttttgagatggagtcttactctgtcacccaggctggagtgcagtggtacgatctctgctcactgcaaccactgcttcccaggttcaagcggttctcctccctcagcctcccaagtagctgggattacagacttgcaccactatgcccagctaatttttatatttttagtagagatggggttttcccgtgttggccaggctggtcttgaacacctgacctgaggtgatcaacccacctcaccctctcaaagcgctgggattacagatgtgagccactgcactcggcccatctcttattttttgcttaagcattttaaattatatacggagtagcatttcattcctaaatactttacattgtaattctaaaaaaaaaatacgttttcttacaaaactgtacagtttaaattgtgattcataggttgggtatggtggctcatgcctgtaattgcagcactttgggaggctgaagagggaggattgcttgagctcaggagtttgagaccagcctaggtaacgtaacaagatccctgtctctagcaaaaataaataaataaataaataagtacataaataaaaaataaaatcagccaggcatggtggcatgtgcctgtagccccagctacttgggaagctgaaatgggaggattgcttgagcccaggaagttgagcctgcagtgaaccgtgatcgtgccactgcactccaggctgggtgacagagcaagtctctgtttcagaaaaaagaaagttgtgattcatattgtcaaattgctgaacagaattttttttttttttttttttttttttttagacagagtctcgctcttgttgcccaggctggagtgcagtggtgggatcttggctcactgcaacctccgcctcctggattcaagcaattctcctgccttagcctgccgagtagctaggattacaggcacccccctccatgcccagctaatttttgtattattggtagagatggggtttcactgtgttggccaggctgatctcgaactgctgacctcaggtgatccgcccacctcagcctcccaaagtgctgggattacatgcctgagccaccacgcctggcccagaattgttttaaatcagtaaatccagattattgaaaaacttgattctatttcacatcttggtttaattctttagtccaaagtggtgtccattctttaagattttaagatggggtagtcacatgctcttttaatctgctgtcttttaacaaaattatttgccaggcatggtgactcaggcctgtagtcccagctactgggaggctgaggtgggaggattgcttgagcccataagttcatggctgcaatgagctataatccagcctgggcaacagagtgagatgctgtctctaaaaaaattaataaaaaaaaattctgctttagcttttttcttgattaattttagacatgagtttcttagcttcccatatagagaaaaatctaatttttatcccaccatttcctgtggttacactttgtttttcaccaaaatgaaatgtttgtttataaagacttctgtagcatttatttacctactattggcttttcacattatttatatactgagttataatgctagagatattttaaaaaatagtatttaatggtcgggcgtggtggctcacgcctgtaatcccagcactttgggaggccgaggtgggtggatcacaaggtcaggagatcgagaccttcctggctaacacggtgaaaccctgtctctactaaaaatacaaacaattagcctggtgtggtggcacgtgcctgtaatcccagctacttgggaggctgaggcaggagaatcgcttgaacccaggaggtggaggttgcggtgagccgagatggcgccactgcactccagcctgggtgacagagtgagactgtctaaaaaaaatagtatttattgattatatcttattattgttgttttattgctgttcttgttccagagttttaaatgtttttttttcatttactgtattgaaatatattgaaataataatacctggagaatagagttgacacaggtagtctggtagcaaatctcttcataaagtatgtacagcagtgatgttcttttagcagttgtatacacctttcagaagaatcatgcttttatcctcctacagagcaaatagatatatatgtattttaatatggtaatgacatgatatgttttcatgttctgggagtggatgaaggaaacagctaagcttactgactgttgcctaggggaacatctaaagattgtatcaaaccaaagttcctgcctttgacagacacaccgtggtatttaggtgaaaattgtagtgtaattaagtaggtaattaagttatttatttcatttagtgatttcagggtgcatattgtagtttacttattactaggatgcagccctacttaaaatttgtaacaaattttattttatttttatttatttttttgagacggagtctcgctctgtcgctcaggctggagtgcagtggtgcaatctcagctcattgcaagctctgcccgctgggttcacgccattctcctgcctcagcctcccgagtagctggaaatacaggcgcccaccactacgcccagctacttttttgtatatttagtagagacggggtttcaccgtgttagccaggatagtctcgatctcctgacctcgtgatccacctgcctcggcctcccaaaatgctgggattacaggcgtgagccaccatgcctggcctgtaatgaattttattatagacatttgataatttttgataatttctttttttttttttttttttttttttgagacaggttgtcactctgttgcccaggctggagttcagtagtgctatcatagctcactgtaactatagcttctgcacctgggctgaagtgattctctcaccttagcctcccaagttgctgggactacagatgtgcaccaccatgcccagctaattttttgtattttttagagagcgggttttgccaggctggtgtttagcacctgggctcaagcaatctgcctgcctaggcctcccaaagtgctgggattacaggtgtgaaccaccacacctagcccttattttttgagacagagtcttgctctgtagcccagggtggagtgcagtggcatgatcatagctcactgaagcctcaacctctggggcccaagtgatcgtcccacctcagtctcctgagtagttgggattacaggcactagccaccataccttgctaattttttgttgagacaaggtcttcctatggcgcccagactggacttgaactcctgggctcaagcgatcctcctgccttggcctccgaaagtgctgggatcacaggcatgagccacagttccaggccagcttatatatttgtaatgctgattactattccattgtctggatgtaccacggtttattcttcacctactaaaggatattttgttttctggtttggggaattatgagtaaagttgctttaaacatttgtgtgcaggtttttgtgtggacataaattttcaacttatttgggtaaataccaaggaggatgatttctggattgttggattaattcttttaatttttgtgggtacatagtaggtgtatatatttatagggtacaagagagattttgatacaggcatataatacataataatcacatctaggtaaatgaggtatccatcaccatttattctctgtttgttacaaacagcccaattatacccttttagttatataaagatgcacaataaattattgttgatggtagtcaccctgtcatgctatcaaacactagatcttatttatgctatctgtatttttgtgcccattaaccattcccactctctccccctgcccagccccccagcctttagtaaccatcattctacttcttcttcttcttttttttttttttaaggtggagtctcgctctgtcgcccaggctggagtgcagtggtgccatcttggcccacagcaacctccgcctcctgggttcaagcaattcttctgcctcagcctcccaagtagctgggattacaggtgtgcaccaccacacctggctaaattttgtatttttaatggagacggggatttgccatgttggccaggctgctctcgaactcctgacctcaggtgatccacctgccttagcctcccaaagtgctgagattacagacatgagccaccgtgcccagccccgttctacttgctatctccatgagttcaattattttcatttttttagctcctgcaagtaagtgagaacatgtgaggtttgtctttctgtgcttgacttatttcatttaacataatgacctccagttccacccatgttgttgcaaatgacaggatctcattattttttaaggctggatagtattttattgtgtatgtgtttattttctttttctttttctttttttttcttttgagacagagtctcgctttgccgcccaggctggagtgcagtggagcgatctcggctcactgcaagctccgcctcctgggttcacgccattctcctgcctcagcctccgagtagctgggactacgggtgcccaccaccacgcccggctaattttttgtatttttagtagagatgggatttcaccatgttagccaggatggtctcgatctcctgacctcatgatctgcccgcctctgcctcccaaagtgctgggattacaggcgtgagccaccgtgcccggcccttatgtgtttattttctttatccattcatctgttgatggacacttaggttgattccaaaccttggctattttgaatagtgctgcagtaaacataggagtgcagatgtctcttctatatactggttttctttctttttggtatataactagcagtgggattgctggaacatatggcagttctatttttagttttttgaggaatctccaaactgttctccatagtggttgtactaatttacattcccactaacagtgtgtgagggttcccttttctctagcatttattatatcctctcttttggataaaagtccttttaactggagtgatgtgatatctcattgtagttttgatttgcatttctctgatgatcagtgatgttgagcaccttttcatgtacctgcttgccatttgtatgccttcctttgagaaatgtctattcagatcttttgcccatttcttaatcggattaatagatgtttttcccattgaattgtttgagctccttattatattctggttattaatcccttattagatgagtagtttgtaaatattttctcccattctgtgagttgtctcttcactttgttgattgtttatttatttatttatttatttatttatttttcttttgagacaagagtctcgctctgtctccaagctggagtgcagtagcgccatcttggctcactgcaacctccaccgccctggctcaagcgattcttttgccttagccttccgagtagctgggactacaggggtgcgccaccacgcccagctaatttttgtatttttagtagagacggggtttcaccacgttggccaggatggtctcaatctctttttttttttttttttttgagacggagtcttgctctgtcgcccaggctggagtgcagtggcgcgatctgggctcactgcaagctccgcctcctgggttcacgccattctcctgcttcagcctcccgagcagctgggactacgggcgcccgccaggatgcgcggctaattttttgtattttttagtagagacagggtttcaccgtggtgctagccaggatggtctcgatctcctgacctcgtgaccttgtgatccacccgctttggcctcccaaagtgctgggattacaggcgtaagccaccgcgtccggcactttgttgattgtttctttcgctatgcagaacttttgtgatggattaattatttttaattcttgtgatgtcagtgaagttgggcctgattatgattggcttttcatgtggcttgagtccatggagaataggaaacaaattaggttgaccagagtaatcaggtttgtgtgacagctttattaatcattgtgaattaataaacctgtgtgctagtgtctggttcagtcttctgtgcatttggaattttcaaattgaggctatcagggtttgttcgccctggatgtagaaagcaaaaatctggatcttacacattcctgggatctgactggtgaggtatacccttataccatgtctgtccactctcttactcatactggtttctgtagttgctcctctatcattaatgtactggccccaggggaaaagcttgctaaaccatagatattcttcgtcagacttacagctaatcacagttgaatgctggccttgctccttctgtctgctttggcttgaaaaatgacttgtgctttgcagtgtgagagaatggccttattttgtgcattcttctttgtagcatccatcaattcaacccattctgatagtttctatgatgataacatttacttctttctttttttttttttttcttttgagatggagttttgttcttgtcgcccaggttggagtacaatggtgcgatcttggctcactgcaacctacacctcctgggttccagcaattctcccaactcagcctcccaactagctgggattacaggcacccgccaccacgcccggctaatttttctatttttagtagagatggggttttgccatgttggtcaggctggtctcaaattcctgacctcaggtgatccacctgacttggcctccataagtgctgggaccataggtgtgagccaccgtgcccgggtattggaaaatgttttcttttaatgagagcatttataccatttatgttttacttaattattgataatttgggtttatatctctcatcttactacttgctttttgtttgttttgctgacattctgttcctttttttctcccttcattggatgacgatgatgattatttgtggtgttttcttttttttttttttgagacaaggtcttactccattgctcaggctggagtgcagtagcactatctgcaaattctgcctcctgggttgaagcagtcctcccacctcagccttccgagtagctgggactacagctactgtagtcccagctactcggaaggctaaggcaaaagaatcgcttgagccgggcttatttttgtagtttttgtagagatgtggtttcactatgttacctaggctgatctcaaattccagagctcaagcaatcagccagtcttggcctcccaaagtgctgggatcatgggcgtgagctcccgtgcccagccactatttcttttctttttttcttttttgagacagagtctccctctgtcactcaggctggagtgcagtggctcaaccttggctcactgcaacctccatacctcaggctcaagcgatcctcccacctcagccttctgggtagctgggatcacaggcatgcaccaccatgcccaactatttttttgtatttttagtagagacggggttttgccatgttgcctaggctggtctcgaactcctgagctcaagcaatccacccgccttcacctcccaaagtgctgggattacaggcgtgagccaccaagcctagagatgattatttttaccttgtgtttcttctccattagtttggagttgtggtggtatgatatatattggtttttgttcatggttcctggttctcaactcccatacctcttgttacagtcttttgttataatattggtgtgtcaggcctcaggaaacaggatctctctcctgccctccattctcctgccccaaggcagaactctaatcttcttccaccattctgactgtgggtcataagaccctcccggagaggctcccacccctctacactagaggcaggaatgctaatgtctttgaacttctagatagctgaatctgtgaaggttcttgcatccatggagggcttggaagctccacagcccttcccctgtacctcgccttagcacacctcttcatctagattctttgcaatattttttataataaacctgtaaatgtaagtaagtgttttcctgagttctgtgagccgctccagcaaattaatcaaatacaaagagggggctgttggaaccccagctgtttgaagctggtcggtcagaagttccagacgcccaggctagtggctggtggtctgacactatgtccagtcagatagtgtcagaattgaattggcggacacccagatggcatcccctgcttggtgtgtggggaaaacccccacacattcggtcacagaagtcatctgtgctgatcgttgtagtgtgaggaatagtgtagcagaggaaagacatggtttggagagttttaacttatgcagtagttattcattttttatttttccttacacagcagttaattttttattatttagaggtaagtctagagattaaaatatgcatctctggtttacagaaatctagtctaataattatacctccttttggacccatgaaagaccttagaacatgccatttatcaccttcctaactcatatgtgtgacattttaaccgatgtttattttaaacccgaagaactgatattattactttacattgtctgtattactttaacttcacccatatatttacccttttcttgccttttatctccccactccttgtatctttaggcttctatctggtataattttctttttccttgaagactacctttattgggtttttgctgaaattgaaggaaaaaattatttttcctcttttttttttgagatggagtctcgccctgtcgcctaggctggggtgcagtggcgtgatctcggctcactgcaacctccgccttccgggttcacgccgttctcctgtctcagcctccggagtagctggggctataggcgctcgccaccgtgcctggctaattttttgtatttttagtagagacggcgtttcactgtgttagccaggatggtctcgaactcctgacctcgtgatccgcctgcctctgcctctcaaagtgctggggttacaggcgtgagccactgtgcccagccttttttttttttgagacggaattttgctcttgttgcccaggctggagtgcagtggcatgatctcggctcactgcaacctccgcctcccgggttcaagtgattctcctgcctcagcctcccgagtagctgggattactgtcatgtgtcaccacacctggctaattttgtatttttagtagagatggggtttcttcacgttggtcaggccagtctcgaccagtctcgaattcctgacctcaggtgatccgcccactttggccttgcaaagtgctgggactacaggcgtaagccactgtgcctgggctttttttttttttttaatttttattgtagccacatacataacataaagtttgccattttaaccacttttcaatttaacattttaaattgtggtgaaatatacgtaacataaaatttaccatctgaaccagttttgaatgtacagtttagtagtaactaccctaagtatctcatataagtggaatatggtatttgtccttttatggtggcttatttctcttagtgtaatgtcctcaagggtcagttttgtttagtgtgctcaataaattttagccattcttgttttctggagtggtggtttttgttggctttttcacccagacatgctatggcatttgctgattgaagtcctgagtataaggctaacttgtccattccctcctccccaagtggtatctgtgtgatatggtttccgctgcaaattggtatttgcttgcagaaaactggagcattgcctgtatcatcatctgttactcatttggtttttcttgttctgctaggaccctggttaggagtagaatgggacaatcccgagagaggaaagcatgatgggagccacgaagggactgtgtattttaaatgcaggtaacttttcattatgaatcagcacggtcatttagtcaagattatatttaatacttgaataaggagggatggagaggaagaaatgtttggctcatggagtagttatattatggaatttgttgtattccaaaaaggcagttattttatttgtggcttaattgctgctgtttgtagcatttttcccttttttaaaaaaattctgactcttgaccttatgcatggcgttgctttcttcgtcctttttttttttttttttttttttaacagtcctttaaattggatgaatgtaaacctttctggctcattaccaatttacaatccagtaagtaaataatagaaaagagaaacagcctagatttccagtaagaaggaattgattacacaaaatacagaacatctgaatagtggaatgttgagccaccattaaataaatttcttatcataggaagagttacatgtcacattgcatttctttgtctttttttttttttttttgagacggagtctcactctgtcgcccagctggagtgcagtggcacaatctcagctcactgcaacctccacctcctaggttcaagcaattctcctgcctcagcctcctgagtagctgggattacaggtgcccacgaccacgcctggctaatttctgtacttttagtggagacgaggtttcaccatattggccaggctggtcccgaactcctgaccttgtgatccgcccgcctcagcctcccaaaatgctgggattacaggtgtgagccaccacgcccggcctgtcacattgcatttctattattatttttgatcgcctgatgtcagaaaaactgcatgaagccctgaaaagggtgctggggagccttcaggcagagcctgtcttctaaatttttgttgttgttgttgatttttattagttttcaatttctgaaaacgatctttccctagtaagctgtttttccttaagtatggtacagtgaacacaatactgccctggaaatcagggggcctctagcctgtttttaacagtcttttttgtttgtttggttggtttatttgtttattttttgagacattgtctcgcctagactggaatgcagtggcatgatcatgactcactgtcaccctgaactcctgggctcaagtgatcttcgcgcctcagtctcctgagtagctgggactacaggcgtgcaccagcacacccagctaatttaaaaaaataaaaataaaaaagagatgaagtttttctatgctgcccaggctggtctcaaactcctggcctcaagcgatcctcccacctcggcttctcaaagtgctgggattacagatgtgagccactgcaccagccccacttttaacagtctttatggtcctgaacaagacaagtttactaacctttaaaatgaaggtcagaattaggtaaccacacagcatatctcctggtccactatttcataattttagaaagtcagggtgttcttaaaaggccaactctacttgtagacttgccatctctgaatttgttcagagctgttcaggttatatggttagggagaaatattttagccaggcccacagattccttaggtacctggaccatgaccttacaaaccctccagtgaaaggacttttttcttttttttgagatgtagtctcactctgtggccaaggctggagtgcagtggcgtgatcttggctcactgcaacctccacctccctggttcaagcaattcccctgcctcagcctcctgagtagctgggatcacaggcgaacgctaccacgtctggccaatttttttgtatttttagtagagacggggatttcaccaggttggccagactgttctcgaactcctgacctcaggcagtccactggcctcggcctcccaaagtgctgggattacaggtgtgagccaccaccccctgtgaaaggactttttatttggaacttaccccagcctacttccttcttgtaaaagcttgcccaaattgtccatacttttatggtctttaatggtctctggatacagtgatattttcaaagtcttggttgctctgagcagaaaaatcaagaattgcttcaagtcctgggtgatgcagggtttgtcctgaaatgctaatgggaagccttggttcagggacattgagtcagtatagtcatgcattgcttaatgaaggggatgtgttctgagaaatgcctgttaggtggtttcatcattgtgtgaacatcatagtatacttaacaaacctgcgtggtgtagcctactgcacacctaggctactgtatggcatagcctattgcttttaggctataaacctgtacagcatgttactgtgctgaatactgtaggcaattgtaacacaatggtaagtatttatctaaacatagaaaaggtacagtaaaaataaaaaattggccgggtgcgttggctcacgcctgtaatcccagcactttgggaggccaaggcaggcggatcacgaggtcaggagttcaagaccagcctggacaatatgatgaaaccctatctctactaaaaatataaaaattagccaggcgtggtggcgggcgcctgtagtcccagctactcaggaggctgaggcaggagaattgcttgaacctgggaggtggaggttgcagtgagctgaggtcgtgccactgcactccagcctgcgtgacagagcaagactccggctcaagaaaaaaaaaaaattaagcagtgtggggtggtacgggtggtatgtgcctgttagtaccagctacttgggtggctgagtcattaggattgtttaagcccaggagtttcaagaccagcctaggcaacacaatgagatctcatcataaaaaaaaaaaagatagaaaatggtatgcctgcatagggcacttagcgtgaatggaccttgtaggactggaagttgctctgggtaagtgagtgagtggtgagtgaatgtgaaggctgggacattcttgtaccctactgtagactttggaaacactgtagccttaggctacactaaacttagaagttttttctttctttaataataaattaactttagcttcctgtaacttttttatgttataaactttaaattttttttttttttgggatggattcttgctctgtcacccaggctggtgtgcagtggcatgatctcagctcactgcactgcctgggttccaacgattctcttgccttagcctcctgagtagctgagattacaggcatgcgccaccacacctgggtaatttttgtatttttagtagagatgggatttcaccatgttggccaggctggtgtcgaacccctgacctcgtgatcaaccctcctcagcctcccaaagtgctgggattataggcgtgagccaccatgcccggtactttttttttttttttttttggagacagagtcttgctccgtcacccacgctggagtgcagtggcacaacctcggctcactgcaacctctgcctcccaggttcaagtgattctcctgcctcagtcttccgagtagctgggactacaggcgcatgtcaccatgcccagctaatttttgtatttttagtggagacggggtttcgccatgttggccattctggtctcgacctcctgatctcaggtgatctgcctgccttggcttcccaaattgctgagattataggcatgagccactgcactggacctgagccttcttccagaatacctcctgaaggacctgcctgagggtagtttacaattaactttttttttttttttttttaataagtaggagtttgctgggcacagcagctcatgcctgtaatcccagcactttgggaggctgaggcaggaggatcacctgaagtcaagagttcgggaccaccctggccaacatggttaaaccccgtctctactaaaaacagaaaaattagctgggcatggtggcatgcacctgtaatcctagctactgggaaggttgaggcatgagaatcacttgaacctgggaggtggaggttgcagtgagccaagatcacaccattgcactccagcttggtcagcagagtgaaactgtgtctcaaaaaaaaaagaaaaaatagaaggagtacactctaacataatgataaaaagtatagtatagtgaacacttaaactagtaacatagccatttattatcattatcaaatattatgtactatacataattgtatgtgctatacttttatgtgactggcagtgtagtaggcttgtttacaccagcatcaccacaaacacgagtattatgttgtactacagcattaagacagctacagcttcactaggagataggattttttcagctccagtgtgattatgggaccactgtagcatatgcggtccattgttgatctacacgtcattatgtggtgcatgactgtatttggattcttagccttggaataactgcttacttcattatatcgtctagtgttgtgttgtcatgcctaaacatttacataattgaagtacatattatcttattataaataactttttaaaatttaaataggcactttgttgacattaaaaaattatatgagtaggtaatgttatctgtgaattccatttcaggatatttatggggcaatacaaaagagatcattgggtctgaagtggtggagaaccactggtctggactacaggaatttaactggtcctttagagtttgatgatttcatgtcatgttttagtttctctgatctcttttgtaacctaaggtaaatatagtaatctcctgagctattattacccataattaatatttgtaacattagcaattaatagtggtttacagtgtcaaaataaaaataaaatgtgcagatgaatgtctaagtgtaacattttatttgggaagcaagaattgcagttcagggcatccgcacagactagatcgtctttggtatatccaaagaacaaagaacaaagagaaacgtggattttttcttttagtttttgagacggagtctcactcagtcgcccaggctggagtgcagttgcaccatctcggctcactgcaacctccgcctcccgggtccaagcgattctcctgcctcagcctcctgagtagctgggactacaggcgcctgccactacacctggctaatttttgtatttttagtagagatggggtttcaccatattggccagactggtctcgaactcctgaacttttgatctgcccacctcggcctcccaaagtgctgggattacaggcataagccactgctcctgggcttttttttttttttttttttttgagacggagtttcgctcttgttgcccaggctggagtgcaatggcgtgatctcgcctcactgcaccctccttctcccaggttcaagggattctcctgtctcagccttttgagtagctggtattataggaaagtgccaccacgcctggctaattttgtatttttagacaggatttctccatgttggtcaggctggtctcgaactcccgacctcaggtgttctgcctgccttggcctcccaaagtgctgggattataggcgtgaaccactgcacctggcccccgccttttttttttttttttggacgcagggtcttgctctgtcacccaggtagtagtacagtggcacaatcatggctcgttgcagcctcaacctcctatgctcaagcagttctcccacctcattttttgatttttttgtagagatggagactccctattttgccctggctggtctcaaactcctgggcttgagtgatcctcttacctcggcctcccaaagtgctgggattacaggtgttacccgccgtgtcctgtctagtacattttataaaaaggagaaatgttacatattgttctgaaagaaagttcattggcactagtcaagttttggagagctggctagcaagctctgattggtgagtgacagtggtgggtaagattagtcttagagtcacggcagattgttttagtagctattaaataaaactggcttcaggttacaacaggcagtctcagcagctgggcttgtaataaactgaattcttggagcaggtgttgtgtgccccgagcactttttccccttggtcccttgactctgatttagttgggtatgacaagaatgacccagtttctgtaatcaactttcccaagatttatccaagatttatggccgtgcgccagtcacccgtgtccttcctaggtactcctgctctctacttcttgttgaaggggtagttgaggggttcaaatatggtaagtaaccttgaagtcctctttaccttgtccgtagacagcagagtggttttcagttttttttttctttcaacctaaaccccagagtatgctctgaacagagctgtgtgtgtcagtattctgcccactcaccttttatttcagtgcttctgtttccaagcaatggtagaagttctcttttctggtgagaaataaatcttaaaatctgacttttcttcaacactagggagcagaatctaactttaatacttagcatcagagaggtcgtgctgttccagcctgtgtctgtggtaatggacatcttaggaaatggatggttgacaatttaagaaacaaagccctagcaataaaggataagtgtttgaaagaaaggataaatgtttgaagtgatagataccccattcaccctgatgtgattgttacacgtgtgcctgtatcaaaatattgtatgtacccacaaaaattaaaaattaaactaaaaaaagaaagcccttgatttattcatcttttgtgtgtcataagccagttgtaaagtgttttgaggatcttggctgagcattaatggattggtataaaatattctcttggtgtggtgtaaagtgttggaagatttttttttttttttaatcaggaaatgtaatgatagtatgtgggcaaggcgcatctctgttcaaaaaggtggtagctctgcttcatttttggaaggttttcttgaatcagagcaaaatcataattgtgtcaacgcaaaagcagttgagatgaatattaaattcagctgattagagaagcaaacaaaaagagcagtctacagcaaggtgcttatctactgtactgctttactcacaggaaaacaacctctctgggtcagctctttagatgttacagcgctgaacactgcacgaaagctgagttctcctctcctgatgaacagctagttatgcaaccttgctgaacactaaacattcctgaaacaaacagggtatcaagatcaacagtatttattagaaactccccagagacctggccttttccagtagcttgtatccaaagctccaacaagaaagaagcttactgtggaagtctgggagtctgttggggaccctttacctttgtgtagtgttgccagattcagcaaacaaaaataccaaatgcatagtgaactttggatttcagataaacagccaatcttttttttttttttttttagtataagtatgagacatgcatgggggcatacttacttaaaaatgatttgctgtttatctgaaatacaagcttaactgagcatcttcgattctatgtggcagtcctgatggggacataggacagaatgaatcttgataactgggttttatgagcacatgctgtttccacaagggccatgggtcaggatgatgattttaccagcagcatgtgtaattggtaggcagaaggaggaaggaacctgaacaggccaaatgcttccaagagaaacgtttttggacacccctccctgtattctcctcctcaccaacatttttctctttagacatggtttggaatttcagtgtttggatacagtttcttaatatattaatgtagaatctcagtggagtctatgtaaattattacagtttacctcttggagatttgttgttattgatgggcacccattcagctagggtttttcactatttgttgaggctgttttgttttctgagaaacctgctggaaatgttccagaaaatattgatctttagtgttagtctttgatctgtaaagggcatagcatccgttttgcaactacctaacaacattcctaactctcctttcatctgcctgcaactaaactcaacagtaataaagatctgttcatgacttcttgtttttttaccatggttttaaaacttgtttattaccactgttttaaaaagtgtagatttagggcctggcgccgtggctcatgcctgtaatcccagcactttgggaagccgaggtgggcggatcacttgaggtcaggagttcgagaccatcctatctaacacagtgaaaccccgtctctactaaaaatacaaaaaattagccaggcgtggtggcgggtgcttgtagttccagctacttgggaggctgaggcaggagaatggcgtgaacccgggagttggagattgcagtgaaccgagatcgtgccactgcactccagcctgcgtgacagagtgagactctgtctcaaacaaaaacaaaaacaaaaaaaacagaaacaaaaattagccgggcgtggtgttgcacgcctgtaatcccagctactcaggaggctgaggcaggagaattgcttcaacccgggaggctgaggcaggagaattgcttcaaccagggaggctgaggttgcagtgagccaagatcaccccactgcactccagcctgggcaacagagggagactctatctccaaaaaaaattataataaaggaataacgaatggctactccataggcagaacagtcccgaggactgctgggtgcccatttttatggttatttcttgagtatatgctaaacaaggggtggattattcatgcctccccttttaagaccatgtagggtaatttcctgacgttgccatggcatttgtaaactgtcatggtgctggtgggagtgtagcagtgaggatgaccagaggtcactctcatctccatcttggttttggtgggttttagccagcttctttactgcatgctgtttcatcagcaaggtctttaatgacctgtatcttgtaccgacctcctagttcatcctgagacttagaatgcctaacagtctggaatgcagcctggtaggtctcagccttattttacccagctcctattcaagatggagttgctctggttcaaacgtctctgacatatttcccccctcccttttacgagagaacccttaatcctaagggctgcagagggatgaagatccactttctgtaacttctttatgctgaacaggggtgatgatattcctgcctaactgttgggtctcttgcattcagggtagaggagctcagttcgaaagcgttggtatggcgaaggccattcataactcttgagttccgacaaaaggtatatctggaagattaataagtgttcagtttaagaaaacatttagtaagcttatcctgcattcctacacaaagagtataatcacagcaatatattccacaacagtaaaataaaaaaaataaaattatcccaagtaaactgaattagaaagttttccatgaactgggcaattgtttaaatcaagctaataaggagtcactagccaattccaatatgtgcccagaattagaataacattacccatcactcttgtttcttctgagcagcagccagagatcactggttggttcacaggaataagtgggatcattctcttgtcttccataggtctgtgggacacaggtcaggaactgtgtagacaaggagtgaggccagttttcccaagcggcttttattggctctataagtcaagtttgattccataaaggaacacacaccattccagttgaagccttggtaaaataagcagtttctccacttgtgtcccaaggtcacccagtcagtgctgcagactatttcctttgggttggggggcgggtcccctcagtgtcctcctttctgtggttcgccagaaagatgttaccagaaaggggtcctgatccaggccccaagagagggttctaggatcttgcaaaggaaagaatttgaggggaatccatagagtaaagtgaaagcaagtttattaagaaagtaaaggaataataaagaatggctactccataggcagagcagccagtaaactaggcttgtaacttaagagacatgtttaacttacagaaacaaatcactgatgtgtgtgtataagccatgagagagatatgggacttaattttgctacaaaagaggatttaatttcctgcataatcagcttccccctattccactgaattaatttcatcaacatacaaggtggatattttctcctgtcttaagcaatctccctcctttgacccctgtgccccttcaggacaagggtaggctgtgctcacttgcctcccagtctttggaactcaccctcgctgggctttgccctattgccccacccagactgctcgtaggaaaggttatgttcatgttgctggattcagtggcaaggcctcagctgttaccttacctgacctggttttagcattggacatggttgttgactttcttcattggcttccaggacaccacactctccaagtttcccttcccatccctttcccttcccatccctttcccttctcctccccttcccctcccctcccctccccttcccccctcccctcccctccccctcccctccccctcccctcccctccccctcccctcccctccccctccccttccctcctttcccctcccctcgtttccatctgtcgcccaggctagagtgcaatgatgtgatctcagctcattgcaagcttcacctcctgggctcaagcaattctcttgcctcatacttccaagtagcgaaactccaggtaccagcaaccatgcctggctaatttttgtatttttaatagaggcagggtttcaccatgttgaccaggctggtctcaaactcctgactttaggtgatctgcccacctcagcctcccaaaatgctaggatcataggggtgagctaccgcacctgatctcaaactcctgactttaggtgatctgcccgcctcagcctcccaaaatgctaggattataggggtgagctaccgcacccagcccacactctctaagtttctaactccctcctggccacttcttcccaggttggggattggttttaactttttgggatcacaagttccttttagagtctgatcatcactgtgaacccacatcttagagaaaactgtacgtatgtttatgttaacaaaatttatcacaaatattagttttcatccttttcaattattattattattatttttttgagatggagttttgctcttgttgcccaggctggagtgcaatggcatgatcttggctcaccgcaacctctgcctcccgggttcaagtgattctcctgcctcagcctccccagtagctgggattataggcatgtgccaccacacctggctaattttgtatttttagtagagatggggtttcttcatgttggtcaggctgatctcgaactcctgaccttaggtgatccgcccttttcagcctcccaaagtgctgggattataggcatgagctactgtgcctggccagaattatggtgacttctaaaaaggtctgatttctttctttaagagttaatggttgttgcctgggcaacgtagtgagatgttgtctcttaaaaaaagtacgaaaagtgttagctggacatggttgcttgtacctgtagtcctagctacgtgggaggctgaagagggagcattgcctgagccctgggaattggaggctgcagttagttatggttgtgtcactgcactctcaccgaggtgacagagtgagaccccctttctttaaaaaaaaaaaaaaaaaattaggcgtggtggctcacgcctgtaatcccagcactttgggaggtcaaggcgggaggatcacttaaggtcagaagttcaagaccagcctggccaacatggtgaaaccctgtctctcctaaaaatagaaaaattagcctgggtgtagtggcacatgcctgtagtcccagctaattgggaggctgaggcaggagaactgcttgaacccaggaggtggaggttgcagtgagtcaagattgcgccactgcactccagtctgggcaatagagtgagattctgtctcaaaaaaaaaaaagaaaaaaagtaatgatcgtaagctgaaatagtgtttataatacaattttgatcaatttatagagttcactgtttcttctttttttttaagtgacaaggtctctctctgttaccaaaataaaaaataaataagtaaataaataaataaatgattttgtatataatccacctacgatttttttttttttttttttttttttagatggagtcttgctctgtcacccaggctggagtgcagtggcatgatcttggctcactgcaacctccacttcccgagttcaaacaattctcccgccttagcctccctagtagctgggactacaggtgtgcaccaccacgctggactaatttttgtatttttagtagagatgggggtttcgccatgttggccaggctggtcttgaactcctgacctcaggtggtcctcctgccttggcctcccaaagtgctgggattacagtcatgagccaccgtgcctggccacccccatggatttaatacttctgttttttctaatgtgaattgtcagtttcatattacttgttagtttatttaaagggatttaacatgcttgcataagatcataaccctttatggtcaatcatactgattatatattattttagtatgtgatattctcttttatgctaattttgattttttagcatgtagaaatttttgaagaccttcagaaaattgtatttatggcctttcttggtgggtaatattttctgtgtttcatttgctcttctttaccaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaaggtaagtggagtttataacggcagagctgacttttatggttttattaaggttcagaattgaaatacccatgactgtatatggatgctcatgactttgctcctaaactggtttatggttccacagaaacggaatcaaaatctgaggaatccaagaattatttagggaaattaaaattcttatgttagcacaggattggtagatttatccagtttgcaattgaaatatttattggcccattattactattcacatcatattatctcgtgttgactaagtaaccaaggctgacgtttgggttcttttctatttcatggtgatgatggtaagttgggaatggaaacagcagtctgaattgttccctatgccgtggagcgtgctggtgccgtctgttaatagtagggagtagttctcacctcgggctgcacatcttcatcacctggggagctgtggaacatgcggcatccttggtcccatcccagatctgctcaatcacaattttgggatatgggctctaatgcattttattgtattgtattgtattgtatttttatttttatacagacaggatcttgctatgttgcccaggctggtcttgaactcttgggctcaagtgatccttggcttcccaaagcactggggattacagggattaagcacccggccttaaaataatgccctttaaaactgctgcacaagaacattctcttttctctgaaactgtatattgtgactttgtacaaggaggctttctagtcattccagtgaactgcttgaatcaaagagagagaaagatagtatttacacaaaaccagtcatggctgcacaagaactggccaggccttgcagcttcctactgtggtgagtgacttggacgaggcatctgggtaaggacccctggtggccactgtgaggataaatttgtggccacttggaggcctgcaatatattttctttcagtctctaaaagaattaagctatagttctgtccaaagtaaatttctttactatcttttgttattgttgttattaataaaagtgcacatggggacaatgtggaaaataaatacatttcttggtacatctactctttagcatacatggcccccattaaaaaaaactcagaataaatcaagagttttagaaaaaggaacaaatggactgttctttataaaacaagatacctttattgttgagaatttagaaattacagattgaacaaaaaagtatcatgattaatgccaccacttagatataagtatcgtaaacgggctgggtgcggtggcttatgcttgtcatcttagcacttttggaggccgaggcagttggatcacttaaggccaggaatttgagactagcctggccaacatggtgaaaccctgtctctactaaaaatacaaacaattagctgggtgtggtggtacgcacctgtagtcccagctgcttgggaggctgaggcaagagaatcgcttgaacctgggaggtggacgttgcagtgagccgagatcatgccgctgcactccagcctgggtgacagaatgagactctgtctcaaaaaaaaaaaaaaaaaagaaaaaaaagacgtaactatcatgaacagtttttactgtttaccctactgatttacttggatttaaagaactacatgcttcatagggttagagttctttgctttattttttcccatttaaaatacaaatagcctgggcaacatggcaaaaccctgtctctacaaaaaaaataaataaataaatgcaaaaattagctgggtgtagtggtgcgtgcctatagtcccaactatttgggaagctgaggtgggaagatcacctgaacccagaaggtcaaggctgcagtgagacatgattgcaccactgcactccagcctaggtgacatagtgagaccttgtctcaaatgacacacaaaccaaaaaaaaaaaaccccaaatatttacatatctcttacccaaaggaagcatttttttaattggttaatctctttctgagaatattaacaaattgcaaatggattttcgtcccctagtttatgaacagctatgtaactcatgaatttttctgtaaatgaccctactacttgagtatcattgcatttaatcattagctagtgtctttcttgattgaaaaggtaaaattttagagattctggagtaatctcatatgttggctggagattagtcaattcagaaattatgagacagcttggtggaatgcagccagtgttggagttaggctgggttcagccgccagctaaggcacttttggctctgacagaagttagagatagctgcttattgtttctaagcctcagtttcctcagttacaacataaaacctaagatataagtgctgttgtgaataacaaatgagatcctacaattaatgatagctgtcagttaggagttgaaacctctactttaagccattgtcttatctcatcaataaaatccagctgaccagctttgagatcgtaccactaagaagagacttactcaataaaggaatcaaaaacaaattaaaaaatccattatgtatggtttctcttggagatggctttggctctggagtgatgcttggactgagatctgagtcctcatgcttagtgccaagttgacctggcaaagaaggctattttaaattttagggggaaggagcgacatctgtcggacacagtgcaaactacagtttgaagtagttgcctgtttcatgagattcctgtagttcttttcaatgatgtcataagcctacaaagctggcttttgggcaattgccgcgataaaacacaagtatttatgtacatctatcatgcatcaatagaaatatttgttttataaaaaagcaagtatctcttaaatcagtgtggaactggaaatggaattggtggcgtccagtctgattccagggtttgggaagttgggcagtgcccagcagacactgagttgacaggacataagtaatgattaagttgtttggccctaactacgtacttaattggaactgtgaggtatttattttggcctaagtaccatgaaaaaaattactgaaaccctaaggaccgtgtggcctgagaaagtttgggaccctctaaccttgaattctgctgctgccttttgtaccctggtttttctttcttttttttgttgttgtttcttgttttttgttttgagacagagtttcactcttgttacccaggctggagcgcaatggtgtgatctcggctcactgcaacctccaccctcccgggttcaagcgattcccctgtctcagcctcctgagtagtcgggattacaggtgccccccactatgccaggctaatttttgttattttttttagtagagacagggtttcaccatgttggccaggctggtctcgaactcctgaccccaggtgatccgcccaccttggcctcccaaagtgctgggattacaggcataagccactgcccccggccatgtatttgttcttctgtgactggcttatttcacctagcataatacactcaaggttcatccacattgcggcatatgtcagaatttccttccttttttttaagttcgcacaatattgcattgtatatgtgtgccacgttttgtttatcctttcatttgttgatggacacttgggttgcttccacctcttgactaccaggaataatgctgctgtgaacttgtgcatataccgtggccttttagagatgtgaagtctgaggcacagaggtgctaattcacttctccaaagccaaaggagatggtggaattgggatttgaacccaggtggtctggttccagattctgtgttcttagacattatgtatgcggattcttttcatgaatagaaagcacaagattctctacacttaacaaatggctgccggaagtatctggtcatgctgaagctgggtgcgctctctaggaagtaccttagggaggcttttacatgtgagtgcgagaagcactccatagcatgtacttctgcgtggttgggaacaatctaaatgtcagcagaagagtatgtacattccttgtggtctgttcatataacaaacgctgtaaggtgtgaagatgaatgtcctggagctccatgtgtcaccgtagtgaaatctcaccactgaacaatagactgttgaggaaaaagtcaggtgcagaaggctctgcggagtagaataccatttatatcaagtttcagaatattaaaaaatgctgtaattgtttagggatatggaaatatatggtaaaaatattaagaaatgcttaagattaaataaacaccaaatgtagtataaggccctggggagggccgggcgtggtggctcacgcctgtaatcccagcactttgggaggcggaggtgggtggatcacttgaggtcaggagttcgagaccagtctggccaacatggtgaaaccccgtctctactaaaaacacaaaaattagccaggtgtggtagcaagcgcctgtaatcccagctactggggaggctgaggcaggagaatcacctgaacctgggagggagaggttgcagtgagtctagattgtgccactgcactccagcctgggcaacacaacgagactctggctaaaaagcaaaaagaaaagtttacctctgggagtagagggagaattgtgtttggagagggccccagaggacttcagttgcatttgtaatatttgtagtgctctttttcttttttgtaatgctttatttcttaatttgggtggtggttactggtatttgtatattatttttggtacccttttatatgtctgaaatgtgtttaattttttaaagggccagtggatagcatacgtgcttatgtatccatgtgaactctgtttttcatgcagtcagctgagcaagttgcaagaagtttctctgaggaactgtgcagtaagttgtgctggtgaaaaaggaggagttgctgaagcatgtcctagtatccttttcaccgagagcttgttattggaatctgactatggattttatacctgtgccagagactgctaattgcctacccattgtccagtcttgacaacttccttcctaatgcagttcagttttgcttggtgtagttggggcccagataaattatttaccttcccagacccctttgcttgcaagtttgccagcatgttcaggtggaagtttctacaccgggctccttgaaagggggcacacttggccaggcgcagtggctcacgcctgtaatcctagcattttgggaggctgaggcaggtggatcacgaggttaggagatcgagaacatcctggccaacatggtgaaacctgtctctactaaaaatacaaaaattagccgggtgtggtggcgtgtgcctgtagtcccagccactcaggaggctgaggcaggagaattgcttgaacccgctaggcggaggttgcagtgagctgagatcgcgccagtgcactcagcctggagacagaacaagacttcatctcaaaaaaaaagaaagggggcacacttgtttggcctctgccttttgcctgttgcttttacccttcccctgccttgagcggatggaaagcccagggctttggcagctgtcttacaagtgtgaagaaagccatccagtacagattgggagagcagaggagagggaacctgggctgctgactgtgtactgggaacctaagatgaatctgcttcagccctggtctgttttctcatgcagttcttttttttttttttgagatggagtcttgctctgttgcctaggctggagtgctgtggcgtgatctcagctcactgtaacttccgcctcccaggttcaagtgattcttctgccctagcctcccaagtagctgggattacaggtgcccgccaccatgtctggctaattttttttttttttttttttgagacggagtctcgctctgttgccaggctgcagtgcagtggcgtgatctcagctcactgcaacctccgcctcccgggttcaagcaattctcctgcctcagcctcccaagtagctggggctacaggcgcccgccaccacgcccagctaatttttgtatttttggtagagacggggtttcaccatgttggccaggatggtcttgatctcttgacctggtcatccgcccaccttggcctcccagagtgctggaattacaggcgtgagccaccacgcctggcctcgtctggctaatttttgtatttttagtagagatggggtttcgccacattggcgaggctggtcacgaactcctgacctcaggtgattcccctgcctcggcctcccaaagtgctgagattataggtgtgagccacatacctggcctcatgcagttattttttagtgggaaagactctggttctgtttcatgcagctgaatgcagtttgttataataccccaacagaggctctttatgaagtttggaatctcttttctctacctgctcttattagtgttatttttgtcatatatttcttttttgcctgtaagcaaaaatgttggaggtaggttaaaagaaaattttaaggatgggcatggtggctcatgctggtaatctcagcatggtaatctcagcattgggaggctgagactggaggactgtttgagaccagccttggcaacattgccagaccttgtctctataaaaaattaaacaaagcaaaacaaaactgggtgtggtggcatgtgcctgtcatctcagctactcgggaggctgaggtgggaggactgcttgagcccaggagtttgaggctgtgatgagccatgatcatgccactgtacttcagcctgggagaccccgtttctattaagaaatttcccatggaggctgggcgcagtggctcatgcctgtaatcccagtactttgggaggccgaggtgggcggatcatctgaggtcaggagtttgagaccaacctggccaacctggtgaaactccatctctactaaaaatacaaaaattagccaggcatggtggtgcatgcctgtaatcccagctacttgggaggctgaggcagggagaattgcttgaacccgggaggcggaggttgcagtgagtgaggtcatgccattgcactccagcctgggtaacagagtgagactctgtttcaaaaaaaaagaaagaaatttcccatggaaaccaaatagactttctttaactttaaaaggtctttccccaattcattaagtctgtctgatctgtacataataacttttgcaaaaaatagcagttttgatcagtttttttctgagtgaagagatgccaggtgaagtagctctctttggcaaaatgccccgacagtgcagtgaaggaaattagatcagacatctctccatctgtgtgtctgagggttcacttcccttgggggaaacagtctgggggtctgttgggacctgtggtagctgcacaggtctctgcctgtctctgccagtctctgcccctgagcagcctcctccgttgaccccagcgtgctgcaaatatgaggtcattttcaaaagtaggcagctggagtgaggggaattgaagtggatgcagaaaagagtttgctgaggagccagtgccacagcagtgtcagagcattctgcattctgcctggcctattcctaaactatttcagaagattggtaatcgggctgtgtacagtggctcatgcctgtaatcccagcactctgggaggccaaggcgggtggatcacctgaggtcaggagttcaagaccagcctggccaacatggtgaaaccttgtctgtactaaaaatacaaaaaattaactgggtatggttacggacgcctctaatcccagctactcaggaggaggctgaggcaggataatcacttgaacccgggaggcagagattgcagtgagccgagatcacaccactgtgctctagcctgggtgacagagcaggactccatctcaaaaaaaaaaaccaaaaaacaaaaaacgggggggccaggtgtggtggctcacgcctgtaattccagcactttgggaggctgaggcaggtggatcacctaaggtcaggagttcgagaccagcctggccaacgcggtgaaaccccatctctactaaagtacaaaaattagccaggcatggtggtgggcgcctgtagtcccagctacttgggaagctgaggcaggagaatcgcttgaacctgggaggcagaggttgcagtgagccgagatcgcgccattgcactccagcctgggcgacaagagcgagactccgtctcaaaaaaaaggacagatgtggcggtaaatgggtttgggagtgctggctgttgggttgctcagagctgtcagcagtgtcctgaagaatcagcatgttgtttgtttatactgcacttttctggagaaaaatgtcccccaggacacgaagaaatgaggtttcacgaagataatcaagtcatgattggtatttgcagatacagtgataaatgtcttgcagctcccgattgaattctcgccagaagttgaagtattgctttgggtgcttaatccagtcatccttttttgggttggtctgtctttgaggttatttactctaccagaactcgaggcagtgggagagctgcagacccgggtgtgtcaaatctgagggtacttccaggggaggggatgagcttcctcctccctcatgacctgcggaggagagtctgtgcccaggtgcttggcctgtgctttcacgggggctccttgaacggtgtgtgtgggaggggcgaccacatattgacagctgttgttcgtggttgatttcaggatgtaggtggtctgtgtgctctgtacagaccttagaaacaataactctaggctacataatgggaagcagcagtgagggaagcgtgattggacttaaacccttcctcagcagcctaacagccgatttagcggggttaatggaaacacagggtggccaaagtgtcacccagaggccgggaaagcacccctcgcatgagcctgtgttaggcggtgtcaggaagctagggcagccgagaggaggctgaggaggaggggcagaggagcagtttacagaagccatcatgcaggtgtgggcccaagggcagaggaggagcgcgaggggacctggagggtgtttgcccggtctggaattttcggcagcctgcaccgactcttttcccttccatttgatgcgacggccacggcaaaattgaggctattctgcaggtactcatattaccgattgaaatgcaactgtttacgagggtagaccccattgttagctcttgggctgtaatagtccaggcagctggcaggattcgggcatgggtagctggcgaccgggtatggagtcatccctttcttcgcatcttctctgccgtccttcccttgttcctgaccttcttgcagagcttcctaattggttcctgcctaaaattatttcctttctaaccaatgctttggagtgatgccactgtttttgtaaagaaactttctccacgttttatgtatgtttgatgactccctgttgcattatggggtgcaatgatatggattttggatcgaggatgacttgggtgtaacttcccacttgttcatttgcacacaatgacacagctctgtgactgctgtgccaccgtttgttctgctatgagaaagcaaaacaacccagcaatcagcatagtgcctgggtctggttagcagtggcagcagcagtgcgggtggtggctgtcactgctgctgttgttattactggatcttagagctcttttttttttttttttttttggagatggagtcttgctctttcactgggctggagtgcagtggcgcgatcttggctcaccgcaaccttctggcacccaggttcaaggattcttctgcctcagccccctgagtagctgggaccacagatacgtgccaccacgcttggctgattttgtttttgttttttttttttctttttttgagatagagtttcgttcttgttgcccaggctggagtgcaatggcatgatcttggctcactgttacctccgcctcccaggttcaagcgattctcctgcctcagcttcccgagtagctgggattacagacatgtgccaccatgcctggctaattttgtatttttagtagggatggggtttctccatgttggtcaggctggtctcgaacccccgacctcaggtgatccgcccgcctcggccacccaacgtgctgggattataggtatgagccacagttcccggtccaatttttgtatctttagtagagacagggtttcaccgtgttggccaggctggtctcgaactcctgacctcaggtgatccgcccactttggcctctcaaagtgctgggattacaggcgtgagccgccgcgcctggcctggatcttggagctcttcttctgtcgctggccactcctcagtcgcttctgtgggacctttctctggttgcagactgttgggtgtaccccaaggctcagacttgggagccctgggcttcttgagagaccttctggggtgtggctggcactcctccacggcctgccctcttccacatctgtctctccagctgcagctttgatacctctgtctggatgtctcatagccatcatagatttagcatgtccaaaactaagacccacgcctgctcatcctgtagtcttttccctcttaataaatgacagttccatttgcacaggccacagatcttggagttgtccttgacactccctttctcccatgccccacacctaaatccattggcaaatcctgtgagccccacttccagagtcagacgccccctctgacatgttctgccctctcatgctgctggtttgctccggcctcctggagactcccggccctcctttatttccctgcaattgtgctcaactcagaagcacagtgacttttactggatttttttgttgttgttgttttgttttttgacataatatagatcaaagtcaaagcagagtgatttttaaaggacccaggtcacctgtcgctgtttcaaagcctccaatatctcccgtttcaagcaaactttgaaaagtccgtttcaaacagactttgaagtggcctgcaaggccctttgtgatgtggcctggccccttattccttgtgaccttgtttctagtacccccaagcccctctgctcgagtcacacaggcgctggcggtcccggtcataggctgagctcgttcccaccccagggccttttgctcttgtcactcctccgccatgtgctcctctcccagatggcgttcccccatttccctcagctctctgctcagatgccctcttagaggaggtggtcttccctgggcactgcatatagaacagccacacacctttcctgcatgccctgctctgtccctgagcacagacaggcctgcctgtgacacactgttgaggcccctgtgtcgtgatcgtctctccccgatgacactctgctttgctcactgcgatgctcctggccctaaataattacttgcagaatagacgagtgcattgaataatttccacacatacacatattagatgagagtgtagctcctccagtagctggcccggtcctgctgcaagctcctctgtctttctctgcggggacctggctaagctgtgccccttcctgatggtgctgcacctgcacctagcccctcacctccacttgtgttgtctgtcggctttgcttttccagccccactgtgttatcctctctgaatccctgtatcaggggcagttggagtgatactgttacaactgcttccaggctaccggacaccctctcaattcctaagtcatgcgcttttgcacatgtgtcccaagttgacccctcttctctgccctgtagatgctatttatctggagattcctatggtaatggtgccccatagaaggtcatgtgctggggtgaggcttgtgtgtataccttaggtgcttcagaaatcaaagttaccctcactgcttttcccctctccttttgttggatagtgctaggatggtttagcgttatgacatttggttctttgtcatttgattgtagatgtttgtctcaagttttgagtatataacaatgaacttttaatttatttttagttttttgagacagtctcactctgtcacccaggctggagtgcagtggcgcagtctccactcactgcaacctccgcctcccgggctctagagtttctcttgccttaacctcctgagtagctggaattacgagcgcgtgccaccacacctggttaatttctgtatttttagtagaatggggttttgccatgtgggccaggctggtcttgaactcctgacctcaagtgattcccccgaccttggcatcccaaagtgccgggattacaggcgtgagccaccgcgcctggcctcacaatgaactttttcgtttctcagtgaagttttggataacttaaaaatattatgtactcctgaaaaaatttgaagctgactagagggtataaaatgaaaagttaaaacgctcatgctctggaattaagagtaactccttttatgtcttttgtgaatcttttgaaattactgtttcttaacatgtgcttttagatatcagaaaggtagatttgtcaaaaaacctgttgtcatcatgggatgaagtgatacacattgctgatcagctcagacacctggaagtccttaatgtcaggtatgaactcttggttgctgaatcttcattaacaataaagctcatctctccttgcttcctcacagcatctctgtggaaagaggtagggagccggaagggttaaggctgccacctgatgatacaggagttaagaaggaattactcaggctgatagtgagggtatggaagtcctcagtaaggttttccttttaatgaaaagcagccccaaattattttcctttctaacacaagcagcctgtaaaatcgagctgcagacatagatgcagacagttgagccaatcaggttcaagatggcagctccatcttcccttctcttttccagccacgtgtacagtaaggagcagacaagatggtgccagccaaagggaaatttcatttacatagtaagattagggtggggtggccagcctttcctggctgtgtaaatgtcatgcctgattgaaccaatctgtgagcattaagtaaatcagacactgcctcctcaagtcaaactaaaatctgtgcatctgggccgggtgcagtggctcactcctgtaatcccagcattttgggagtctgaggcaggcggatcacctgaggtaaggagtttgagaccagcctgaccaacatggagaaaccccgtctctactaaaaatacaaaattagctgggcgtggtggcatgcaactgtagtcccagctactcaggaggctgagacaagataattgcttgaacccgggaggcagaggttgcagtgagctgagatcgtgccattgcactccagcctgggtgatagagcaagactccgtcaaaaaaacaaacaagggccaggcgcagtggctcacgcctggaatcccaacactttgggaggctgaggcgggcggatcatgaggtcaggagatcgagaccatcatagctaacaaagtgaaaccccatctctactaaaaatacaaaaaattagccgggcgtggtggtgggcacctgtagtcccagctcctcgggaggctgaggcaggagaatggcatgaacctgggaggcggagcttgcagtgagccgagattgtgccactgcactccagcctgggcgacagagcgagactccatctcagaaaacaaacaaacaaacaaaaaatctgcatctgctgccagcttgcctttttcttcttggaagtcccctctctcttactagagagagagctgttttccatcttctttctcttgccttttaaacctctgctcctaaactcctcatgtgtctgtgtcctaaattttcctggtgggagaagaggaataccaggtgtataccccagacaacgcagctgcttcgctagtagacatttttatacagccagattttggtttacttgaatttatctaactttaactttaaggacacatttaatctttaaggacactttatttatttatttatttatttatttatttgagacagtgtctcgccctgtcgccaggctggagtgcagtggcgtgatcttggctcactgcaacctctgcctcccgggtttgagcgattctgctgcctcagcctcctgagtagctgggactacaggcacgagccaccacgcccaactaatttttgtgtttttactagagacggggtttcactatgttggctaggatagtctcaatctcttgaccttgtgatccgcccacatcagcctcccaaagtgctgggattacagtgtgagccactgtgcccagccttatgtatgtatgtatatatgtatgtgtgtatatatatatatatattttttttttttttttttttgagacagagtctcactcttgtcgcccaggctggagtgcaatggcgcgatctcggctcactgcagcttccccttcccgggttcaagggattctcctgcctcagtctcctgagtagctgggactatgggtgcccaccaccactgccagctactttttgtatttttagtagatgcagggtttcgccatgttggccaggctgttcttgaactcctgacctcaggttttccacccacctcggcctcccaaagtgctggaattacaggtgtgagccaccatgtcccgcctctttaaggacactttaatctttaagggcacattgattattatagccttgcaaacggtcacatgaggtgattcatgaataaggaatgtgttttaacttttaccaggtggggatgagttagattttcattgaactgcaagatcttatttttagcctgaccgtaaagatggaaggttgggggaggtgatatttaattggggagtaggagaggagaggtgatattattaaaactgcttgtttatttgaaaacttctagcgtttaattgctgtaggaatgagtaatttcattgggatactgtttaattctgttttgataaggatttttcattaatctacctattttactaatgtcacacttttctaggccttcctgaatatttaatttgttttaatctcagaacctaactttccaagggcttagccaggcttcctccatttttttttttttgaggcagagtctcactctgttgcccaggctggagtacagtggtatgatcttggctcactgcaaccttcgcctcccagattcaagtgattctcctgcctcagcctcccaagtagctgggactagaggtgcctaccaccacacccggctaatttttatatttttagtagagacggggtttcatcatgttggccaggctagtcttgaactcctgacctcaggtgatccatctgccttggcctcccaaagtgctgggattacaggcgtgagctaccgtgcccagcacaggtttcccctttcattcttgaaccatttttgcatagacatgtgagtgtacagtaaagccggtagacaggcctgaatgagttgtgctcccaaatagagcaaacgggggcaattcaacccatggtgtctcatcttctggaaatacgggcttgtgttttttaatagtatcgtctttcaaagtgactgtcaggattgaatactttctgagattagggttttgagaaataatttaaggggcaataatttcatccatcctcatagccaaagggcagactctatgtttagagaagcaaaattctagcccatgattcagtgtatcagtaagactctggagaacgggactttgttttgcagtatccagagccatatcttgtgaagctggaagctcaccttgcaaatgcctgagttttgggtttaggaagcctacagccgcatacaggtgccctaatcctgtgaaagcatctttacacagctgataccaaaaagttgtatgttgtaaatgttaaaaattaggtagtcttgattcacttgaatcattaaaaaagtgatttttaaaatataattccattttaagattgaaacaaatcaaaccccttagattaaaacccagattgttgctttcaacaactatttcagttgggtttactgtatagaaataagtacattgtatcttttttttctacacagtgaaaataaactaaaatttccctccggttcagtattaactggaacgctttctgtactgaaggttttagtcctcaatcaaacaggaataacgtgggctgaggtaatcatatttctttgttttattacacattaataagcaattaaaaatgtttggtttaatagagaattgttagtacagtttaatagtacaactgtggcttcatttaaatcatcccagtatctattaatagataacaagattcattaaagtgccttataaaaacgagttaaaagagcatcatagttgagttttgcatctggaaatccatgtcctatctcagctcattttgacttgttctggtgcctttataaacagtggcgctccgttatggtatgaaccagtatgtgctgagcttcaaaaagccgtagtgttggctattgactagcttcctgagttttcctgttagttttttttagaacagaagccaagcagcagaaaggttctcacatacttttcttgttagaagttcggctcttggaatccactgttcattttatacagccgggctcaaaagtagacttgtgggtccttggcacagcagcatttgggacttatatctggcagtactatttcctgtctgaggtgtactgacttcacacacccagagcattccactttctttttttttttttttgagacggagttttactcttgttgcccaggctagagtgcaatggtgcaaccttggctcactgcaacctttgcctcccaggttcaagcgattctcccacctcagcctcccaagtagctgggattacaggcatgtgccatcacacccagctaattttgcatttttagtagagacatggtttctccatgttggtcaggctggtctcgaactcctgacctcaagtgatttgcccgcctcggcctcccaaagtgctgggattagaggtgtaagccaccgtgcccagcccactttcatttttatttatttatttttcttgagacagagtctcactctgttgcccaaggtggagtgcagtggcgcaatctcggctcactgcaacctccgcctcccaggttcaagtgattcttccgcgtcagcctctcaggtagctgggattacaggcatgtaccaccatgcccagctaattttgtatctttagtagagacagagtttctccatgttggtcaggctggtctcgaactcctgacttcaggtgatccacccacctcggcctgctaaagtcctgggattacaggcgtgagccaccgtgcccagcccactttcatttttatttatttatttttcttgagacagagtctcgctctgttgcccaagttggagtgcagtggcatgatctcggctcactgcaacctccgtctcctgggttcaagcaattctccagcctcagcctccaaagtagctgggattacaggcgcttgccaccatgcccagcttatttttgtatttttagtagggacagggtttcaccatgttggccaggatggtcttgaactcctgacctcaaatgatctgcctgtctcagcctcccaaaatgctgggattacaggcgtgagccactgtgcccagcttgggcattccactttcaaaccaagggtgtagaaatacattcccagccatgttcacccaggaagtgccacagaggccactcagtgagagacaggtgggccccttgtgcccttaatatgcccgtggccatggagcctctttcctagggcccctcctctgtgaggcgcttactccctctcaaggtgtagatgtagctggaagacaagaaggggccagacactggcactggggctcacacctgcaatcccagcgctttgggaggctgaggtgggaggatcacttgagcccaggagtttgaggctgcagtgagctaggattgcacctttgcactccagcctgggtgacagagcaagacgcatctcaccctccaaataaactaggaagggcacacagaaattgaagtggtggagatggcagtaaagttccagtgagaaaatttagaaatagttggtgaggctggtcatggtggctctcgcctataattccagccagcactttgagaggcccaggcaggagaatcacttgaggccaggagttcaagacccacctaggcaacatagagagatcctgtagatgctatatatatattatatattattatacataattatataatatataataattttttgtaatttttttttttgtaaaaaaaaaaaattaggctcatgcgcagtgtggtggcagcaggcacggtctcgacatgcagaaagacgccagcaagttcgtggatctgtgcgtgctgcagaaatgctccaccagcaactgcatcatcagtgccaaggaccacacatccatgcggatgaacgtggccaaggccagtgaggtcacgggcaggtttaacagccagtttaaaacctgtgctatctgcaggactgtttgcaggatgggtgagtcagatgattccattctctaattggccatggccaagggcgtcatctcaactatttggtttttgagatggagtcttgctctgttgcctaggctggagtgcagtggtgtgatattggctcactgcaacctctgcctcctgggccaaaatgattctcctgcgtcagcctcccaagtagctgggattacagacgtgcactaccacgcctggctaattttttgtatttttagtagagatgggttttcaccacgttggccaggctgttctcaaactcccgacctcaagcattctgtctgcctcagcctcccaaagtgctgggattacaggcgtgtgcaaccatacccggccatttttgtatttttagtggtaatgggtttcatcatgttggccaggctggtctccaactcctgacctcaagtgatccacctgccttggcctcccaaagtgctgggattacaggcatgaactcactgtgcccgatctcaaagaacttttgattggagagaatcatggatgtagaatatttgtcataaatatataatgaaaactttaaaaaatgtataattaaaaaaataatgaaagaagaaataattgttgagaaatttatgaaaggatatgaaaaattagcatatcctttacaaacccagattggcatttagaattgaggaaaggtgtgtaacatcaatttacttattttggttaagcaaattctatcaaataataatatgtgcagttagtatctcctgttccacctcgtagctgctttacctaaaccatgcattgacacgtacctccaaggcctcaaagtgcccacagtgtgtgctcccacagcattaaaatgcacccccttaacattttatttatcaccccccaccactattccaggcctgaaacagtcttatgaactgtccgtgaggcacttgtttgctgaaacagtaactgagctgaattcttgtggtggttcctatgaacacccgggaagaaacagccagcagaggccgcctgagcctgaaccgagtttctcttccaggtgctgcggtgtgtcgcggggtgcccaggcctggaggaactctaccttgagtctaacaacattttcatttccgaaaggtaactagcacttacttaaatgcatctatccccatttaatcatcattctgagtaaataaatggtctcaattatatctaaccttaatttttagaaggatttgcaaacaagaattaggaaaaatgcttattattcattgccttcacaaattagaatttcactaattggttctaatcaaaggaaactcatcagaattaaatatttgtgaagacatgagttatattagttttgcatcagtgtattaacttgctgtttcttttttttctttttctttttttgagacagagtctcactctgtcgcccaggctggagtgcagtggcgatcttggctcactgtaacctccgcctcctgagttcaagcgattcttctgcctcagcctcccgagtagctgggattataggtgcctgccaccatgcccggctaattttctttatttttagtagagacggggtttcaccatcttttacggggtttcaccatcttggccaggctggtctcgaactcctgaccttgtgagccactgtgcctggccaacttgctgtttctaaatggaagttctgtaggatatgctataaggattaaataatgtatttttcattagcatcatctgtttaaggtcattgtaccaaagtacatgtaaaactttgttctctgaaatatattgttgcctcatctcctttttaaattaataatattaaattactatgtaaaattaacctaactgtgggaaaatttacaacagattctgaattaaaggattcagaatcttaaagattttcgtttacagaagggtttcattatgtaggcaaatgcaggttttttgttttgttttttttttgagatagagtttcattcttgtcacccaggctagagtgcaatggcaccatctcggctcactgcaacctccacctccctggttcaagtgattctcctgcctcagcctcccatgtagctgggactacaggcacgtgccaccatgcctggctaatttttgtatttttagtagagacggggtttcaccatgttggcccggctggtcttgaactcctgacctcagatgatccacccgcctcggcctcccgaagtgctgggattacaggtgtgagccaccgtgcctggcctgcaggttttttaaattaaatttttttattttgagataatcatatattcacatgaagttttataagaaatgatacacagagatcacttgtacccatgacccaggttcccccattggtaacaagttgcaaaactatgatataggatcacaggctaggtgtgacactgataccggcaggaatatgtgcatcaccacagggaccactcaggttgcccctttacagtcatatttacttgcttcttatccccagccctccatcgcaccaaatgcagggattttaaggctgtatctttgaaaacaattaagagataaattcacggtgaaaaaattttattttccatacaggccaacagatgttctccagacagtcaagttattagatctttcctctaatcaattaattgatgaaaatcagctgtatctgatagcccacctgcccaggtaatttgcccctaaatgcctgatacaatagtgttcagtcaattcttagtgaagcagttttcatatgctatgtatgctttctcaatagaaacgtggtaacaatgatggaatttctaaattgagtaattccctttgggaaattttcatttgaattcatttagaaaatttacttgtgaaccctgtataatgtggactatgtctgtaccagataatttgaagaatgaataatttgaccctggtgataatgcggaaagtcttcattcattaaactccgggcagtagaccgtgtctctttcctctgagacgcatttagcacctgacatagcagtaggtactcaagaaccattaggtgactatggagtcattagaatacaggataaagagttcactttgcatgtcctaagttggactttatggtttctaagtattttacatgggattaaaaacccagggtgtaggaaaaaaatttacaaaccgagtctggttgataccccatagcattttacattgttctgtgtaatcaaattgtacattttgaatttcaggttagaacaattaatcctctctgacactggaatttcttctctacattttccggatgctggaattggtatataagattagtaaagttccccactgcccccccacactatacttcagctactttcacttctactgtgtaacttcattcctctttttatagggtgcaaaacgtccatgttcccatccttgaagtacctggtagtaaacgacaatcagatatcacaagtaagagctgctcggagtatgcccagcacactgttgcctctttccactctcatggcagagtttggaggttccttctaccaaaaaagtaaaaagaaatttaaatcgaaagagaaatacctcctcagagtgaaactcctcataagaagccaaaaatattaagaaagaaattagttcacttcacacttaagtggacttcacacttaaatggcacattaatagagtaaaaggggccgggtgtggtggctcaagcctgtaatcccagcactttgggaggtcgaggcgggcggatcacctgaggtcgggagttcgagaccagcctgaccaacatggtgaaaccccatctctactaaaaaaaaaaaaaaatcgcaaaattaaccgggcgtggtggcgcatgcctgtaatcccagctactcgggaggctgaggcaggagaatcgcctgaactcaggaggcggaggttgtgatgagccgagatcgcgccgttgctctccagcctgggaaacgagcgaaactccatctcaaaaaacaaaacaaaacaaaacaaaaaacaacagtaaaagtatgtggtctttctagaggggattgcttagtgcatgatgaaattccctgcctcagattagaactagggacatgctttcctgttgctggttcaaacttctgcaaaagtggcatgaacgtaccgcttttcatttatttccttttgctgtgtttcagtggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgaggtgagcactggcgtcatgactagatattttttagactagaaaataaatgattttaggccaggcgccgtggctcacacctgtaatcccagcactttgggaggctggggcaggctgatcgctgcagtccaggagtttgagaccagcctgggcaatcttgtgaaaccccatctctacaaaaaatacaaaaattagctgcatggtggcacgcgcctgtaagtgcttgtagtcccagctactcaggaggctgaagtgggagaatcacctgagcccgggaggccaaggctgcagtgagccatgaacatgccactgcactccagcctgggcaatggagtgagaccctgtcttaatttaaaaaaaaaaaaaaaagtaaaaaaattatttttgaatattgtaaagggggtgagatgtagctttccttggaatggtaaagattagccttgtgcagtttcataatagtggttcttttccagctcctcaggagagagtcctccacttagatcagtgcagtatcatttgaggcacaccaggcaccgtctccatgttttcagggaatgtaggcagaaagaacacagaccacagagctgctttctcctccccttctcagccactcttccccataaaagtgggaagtccatgccttgtccttgccagcacttttgtgcattcactgggagtcagtcagctccaccagagcaggcgcctccaggcagacctgggggaggcgacccagggtacctggtgtagtcctgaaactggcctatgcgcaagtactcgcatgaattaaaagtgtaggccaggcacggtggctgacacctgtaatcccagcactttgggaggccgaggttggcagatcatgaggtcaggagatcgagaccatcctggctaacacggcgaaaccccgtctctactaaaaatacaaaaaaattagccaggcattgtggcatgcacctgtaatcccagctattccagaggctgaggcaggagaatcacttgaatctgggaggtggaggttgcagtgagctgagatcatgccactgcactctagcctgggcgacacagcgagactccatctcaaattaaaaaaaaaaagagtgtaaaactgaaattcttttttcttttctaataaacccctgagttctgtcaatgttaaaaagaagggtgaaaactagatcttgtccctctcaatttgattattttctgcatgtgctatggaggaaggacaaggtgcaaaacgcaaaggacatgttagaaaaaagctttgtaataggcttgtttttatgtcacatgaacatagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgagtacgtgcgtatacactggtggccttcaggtggtggatttccagctggaacaaagttttttcttgggtatcaaaagaggttctcagtgttgcttttgcccttcttcctttcctgggcttcttgtattcatctgaatggactataggcactttcctggggcgagggcggcagggcaagagcagtatctttcagcaggaggaacctgggagactgtttatgttcttgaaatggagaggtttgcatttggggaagggaaagcaattcttttatttttaagagatggagttggccgggcgcggtggctcaggcctgtaatcccagcattttgggaggctgaggcgggtggatcacgaggtcaggagatcgagaccatcctagctaacacggtgaaaccccgtccctactaaaaatacaaaaaaaaaaatgagccgggcgtggtggcgggcacctgtagtcccagctactcaggaggctgaggcaggagaatggtgtgaacccggggggcggagcttgcagtgagccgagatcacaccactgtactccagcctgggcgacagaacgagactccgtctcaaaacaaaaaaagagagatggagtcttgctctgtcgcccaggcccaggctggagtgatctcagctcactgtaacccctgcctcccgggttcaatttattctcctgccttagcctcctgagtagctgggattagaggcgcccgccaccacgcccgactaatttttgtatttttagtagagacggggtttcaccatattggccaggctggtcttgaactcctgacctcaagtgatccacccgcctcggcctgtcaaagtgctgagattataggtgtgagccaccgtgcgtagcaggaaagcatttctttttctttttttttcttttgagacagagtcttgctctgtcacccaggctggagtgcagtggcacaatctcagctcattgcaacctccacctcctgggttcaagtgattctcctccctcagcttccagagtagctgggactacaggcgcacaccaccatgcctggctaatttttgtatatttattttttgagacggagcctcgctctgtcgcccaggctggagtgcagtgccgcgatctccgctcactgcaagctccgcctcccgggttcacgccattctcctgcctcagcctcccgagtggctgggactacaggcgcccaccaccacacccggctaattttttgtatttttagtagggacggggtttcaccgtgttagccaggatggtctcgatctcctgaccttgtgatccacccaccttggcctcccagagtgctgggattacaggcgtgagccaccgcgcccagccagggaaagcacttcttaaatgtaggttcttctcttgcatatgtccaccaggtttcaggtggcgcaccatgctccactgtaggaagggtaggaagcactccagtttatgtctgaggcatccgtatatatatatatttttttgagatggtgtttcgctcttgttgcccagactggagtccaatggcgcgatctcggctcactgcaacctctacctcctgggttcaagtgattctcctgcttcagcctcctgagaagctgggattacaggcgtctgccaccatgcccggctaattttttgtatttttagtagagatggggtttcaccaggttggccaggctggtctcaaactcctgaactcaggtgattcgcccgcctcagcctcccaaagtgctgggattacaggcgagagccaccgcgcccagccggcatctgtatttttttaaagccccccaggtaattctagtgaataggaaagttcgtatgagtgtagttctgcagtaagctctcgtcccgagggctcgctaccaaggctggcacttggcatgcacggtggttccttaaatcctccagcctggttcttcaggctttgaagctaagaattcatgagtctttgtccctgatgtactttccattttgttttgatgacattattactccacatttcgcttttatgttatttccttttttatatttcttaatgcaagaagctcgctgcataaacgcttcaggcttgaacagtatgtttaaggaagaaaagcagcctagaggaatcactttcaaatgactccattagccagcccaatctcctggccacgctcggtgaattctaaatcactcgggggtgggcaagggaagatgtgaagcagccgggcaggtattgttgagtatttcactgctaagaatgttagaagacaaaagcacagatagatggggggatttagagaaatgttgtcactgtttggcctagagcaggaaaaaagtactgctttcctcctctcctgtggaggctgtggtccaggcctaggaactggtttgcagtatggtactgagcacccagcctggcactgcacggtctggtggaaacgtgagaagtgtcctgtggatcgtgtctcaggtggcaccaggtttctgtcagcgcagaaagagaactgttaccaaaggtgacactcggggaaaacatttgaagtatttgaaggcagtcttctcttgctagttttgagtcaggacacctaaggaacaatgatgtaatacacatgtaaacatgttgcttttcatttgttgtcttttgttgagtttcactggtcattaacaatgagctagataagctacagagtctgcagctctgggtagatagaagattctgcccttggaagtggtcgttgtccatcactcctaaaaatcacactgaataaaggcagctccatgtgtcctgggaaaggcacaggctctctggacgcttacctatcctttgtttgtttgtttgttttgtttttacttatagtggcctttggtttatcattcatctcttttgctttcttaaacagaatatggtgcacctgaagattgggaactcaaaacacagcaaccacttatgctgaaaaaccagctactaagtaagaatctcagattcaaatagtttatttgtatttgagtgcttaggtgctgaaacagttagtgtgtttctcttaagtgtgtacctcttaagtacctaagtaaatgccttgagttttaaatgaaaatttttttttttttttttgagacagagtctccctctgtctcccaggctggagtgcagtggtgtgatctcagctcattgcaacctccgcctcccaggttctaagcgattctcctgcctcagcctctggagtagctgggactacaggcatacacaaccatgcccggctaattttttttaatcgagacggagttttgctcttgttgcccagactggagtgcagtggcacgatcttggctcaccgcaacctccgcctcccgggttcaagcgattttcgtgccttagcctcccgagtagctgggattacaggcatgcgccaccacacccagttaattttgtatttttagtagagatggggtttcaccatgttggccaggctggtctcaaactcctgacctcaggagatccacccgcctcggcctcccaaagtgctaggattagcggcatgagctaccgcgccctgtcaaagaaatgaattctttaaaacatgtttaaattcttatacatttttgtaactcctatgttttaaactcatttaatagtgttataaatgtgggaggtattggagttgtgaaccaaattgtgatttgtgaatttatgacttgaaaacctagccaagctgtaaggaaagaagtactaagtggggaaaagggaaagtattgtccagctatttctgttgttgttagcaatccatggaaggattaatagaaagaattttaaacattgattagacctgccaatttgcactgaatacctctatcatttggccatctgttgatgtgtgtggataatttaaatccatataatagtagatatcaattagtctttttctttgtttctcttaaagcactgaagataaaataccctcatcaacttgatcagaaagtcctggagaaacaactgccgggtaagaagaaccagcctgtcttttccttaaactctgaatcatcggcctaggtatgagtcagctaaaattaaaacctttaactcatgtctcaaagtgtggacctcagaacttacaggttttcattagtcttttatattctaaaatacaatcaatcatgctaatatcactcccccatgcccccaaaagttcaggtctcccctaactttatcagctgaaagcagttctgttaaaattggaagcccctgcatataattacacacacacacacacacacatatatatatacacacacacacacaattttttttgagacagggcctcactctgtcacccaggttggaatgcagtggcaccaactcagctcacggcagcctctgcttcctgggcccaagcaattctccagcctcagcctccacgtagctgggactacacgtgcgagccaccaacgcccagctaatttttgtattttttgtagagatgggttttcgccatgttgcccaggctggtctcgaattcctgagctcaaagccatcctcctgcctcagcctcccagtgttggaattaattacaggcatgagccactgcagttggcctaagttgtatttttaaccaaaaaacctgagaccttgaatggcatagccttttggaagcattccccaagcctgctgctgtttccagggagactgtgacactgggtttggggtctgcttctcatcccttcataagagaggagctgtgtcctggtgaaccaaattcttacgggaggtttgtgactttgcttacattctacttctcctgactgattaggagtccctgcaaaaacaattcgcagatgctcttttaatggacaccctgaaatggttttctttgagaaagctaccttagaacttaaaaaaattgtggtactggaactgaattacttttatttggaaaataaatatgcttgtgtcaataaagtagatcaacataacttaccttaaactttcactcaaaagaaaaatgaaattatagtctatttttgagtatgccatgatactgtgaattctcaagattaaacttgattcatagctaaatgctaaaatataaataatttagagcagtgaggatttaaataaatgaaatacacatcagcttaatgactctagtacactgggtttctttgcccatcagtgcagtaaattcacattgatttttaaattagtttctatcagataaagcaagcttatcatggtattgcttatagaaggccttagttgtgttcaaagaagtacctttctgattgataaccatccatttaatttaccacaacgtctccatttttatttattcacaatccagtttctactcctgtaatatgtaatttggctactgctatataatgggttagaattagtgatttcccccttcattattctgttttcaaacttagacagacagtaaaggccctggtggagacagactagtcaaagagggccaggactgttttatttttgatatatttttttcagatggggtctggctgtcactcacgctggagtgcagtggtgccatctcagctcactgcaggctccatcaccttgatcccgggctcaagtgatcctcctacctcagcctcctgagtagctgggactataggcacgaaccaccacaccccgctaatttttttgatttttagtagagatgaagcctcgctatgttgctaaggctggcctcaaactcctgagctcaagcagttctcctgtcatcacctcccaaagtgctggggttataggtgtgagccaccatgcctggcaggccaggactttctgtgaatgtttttggccttcgatgtctttgcgtgtttccttttgcctttgcagatacatcaaatcaattcatgggaatgttaccactatagagtatttgctcaagaatattgtcattagacctgtttcgttaagctttccttttcagtctttctctggaaggcactgaggtagacctgccaaggcctgccgtctgggcatatgcctgaatgcagcccttggctgggggtgacagtgccgccttacccttctctacttccacactgtacacctgactggtatcccaggtcttctgagattcagttagccattttgggaacacccactgcattcatgctgtttttattaatctttgggtagctagcagagattcgactatccatagaaattatatgtaagaattactactttaaactattcagaatctgagtcctatattctataaattcagcagtaagccagcagattacaagggttcctttttttccccttttttatttgcttttctgtttctcaaatgtgcactcactcactcactcatacaaaggttcttaatactaattcttatgccacatgctgtgaatatttaaccactaacataggtaaatgtcttctaaacagaaaagtaatagccaggcatggtggctcacacctgtaatcctagcactttgggaggccaaggtgggcaaattgcttgagcccaggagttcgagaccagcctgagcaacatggtgaaaccccgtctctacaaaaataaataaatacaaaaattagctgggtgtggtggtgcatgcctgtagtcccagctgcttgggcggctgaggtgggaggatcacttgagcctgggaagttgaggctgcagtgagctgtgattgagccactgcaatctggcctgggtgacagagtgaggccctgtctaaaattaaaacaaaacaaaacaaaactgcaatatctttttttttatccattagattagcaaaattaaaataatactggctggcatgaaaaagcagtatacccttttttaaagtcatgtgggaactactataaaaagttaaaaatacacatatgctctgaccaagcattgtatcttgcagcatttgtaatggtaaagatagtaagaatctaagtacttgccagcggaggaatggtgaataagctctggtggaaccacacagcacacaaggcactgtcgtgtgtcaccgaggagagtgaagcagtctagagctgcgctgtccagtgtggctgcaataaccacatgtggctatttaaattcattaaaataaaataaattgagttcttcagtcatactcgccgctttccaggtgctcagtaccacatgtggctgccatactgggcagtgtatggctagaggacatggcatggaattggcatgaaaagctataccatcatgtcataaagaaatacaaatgtagtacgtcaatatattataaaacctatacatccttttttttttgagacggagtctcattctgtcacccaggctagagtgcagtggcatgatctcggctcactgcaaactctgccttccgggttcaagcaactctcccggcctcagcttcccaagtagctgggataacaggtgcccgccaccatgcctggctaatttttgtatttttagtagagacggggtttctccatgttggccaggctggtctcaaactcctgacctcagatgatccgcccgcctcggcctcccaaagtgttgggattacaggcgtgagccactgcgcctggcttaaaacctatacatccttatatgaacacagaaaaaaaaaggcctagaggtatacctctcaaatttttaacactggtcataggcaggtaaaaagaaataatcagctatttccatattttctgaatgttaagacagtcatgttactatattaaaaatggtaatgctatttattacatagagattgctactttcttctatagaaccggtatgagtaggcaggttttttttttttttttgagacaggttctcactttgttacccaggctggatggagtacagtggcgcgatcatggctcactgtagccttgacctcctgggctcaagtgatcctcccaagtagctgggactagaggcgtacatcgctatgcttggctaattttttattttttgtagagatggggtatcctcatgttgcccaggctggtctcaaattcctgggctctgatccctctgcctcccaaagtgctggggttacaggtgtgagcaggccaggcagatttcttattagaactgttttatgaccaaactttttgtttctggcatgtgttaggagtatgtcactccccactggtgtgcagcaggtaaccccttctctcaccagccttcaaacaatgaaagccagtccgtctcaatcttttgaaaggactagactatcacatattcacacatgaaagagcaaattgttaattaaaattataaattctattaactgtattcaatacatacaaaaaggccagtttttattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccagggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 2510 - DNA, 81554 bp, Homo sapiens; identical to SEQ ID NO: 2509

SEQ ID NO: 2511 - DNA, 79375 bp, Homo sapiens
caagacctggagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaagcgcagcgcctgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttcccttcttacccccacccactccaggtactccagctctggcttggggatgtttgccagctttgaggcgcaaaggcggcgggagttgggatgcggggtgtcggagggagactgagggtcgcccgggcaccgtgcctgcaccctggattatagtacagagagcatttcttgttcaaacaattcctcaaatgtgtgaacctgagaatcaacattgtgtataactgtggtttgagcatttcatcctgcttccttgcaaaaggattagaggcagcttaaagattaaataggtatggaacgggtgctggggggggccagggaaaacttgagtagaaatcacagggaggtggtgtgctccagggaccccggaagaactgtgtgatttcaaagccagctgattaaaaaacctttgattagaaaggactgcactgttgctccagccctcagaaaataatactgtgctcagtcctgataaacaaaatgcccaggtgtggaggtaatgaggcaggctcattttttttaaaatacaaaataaatcttggaagtaagagttaagatgagaagtttggtcttaagccatctccacccaatactgcaaggtgagaggctgaccccctacctaacgaaaaggaaaggaaattgagtctaaagggaagtgattccagctcctatcacaggatcatagtggttttgcatctatatgtatatttctgcctgtgcccagttttggaagaaaggaccttgtattcaacccaacgctgcttgtccttgagttagaaggataaggcagatggtgtcagcatcccaaggtgtttcttcctaacctttcttattgtccttccttgcctcctgcaccaaatctcttggggagggagcagcccaggaggaaataatagatcgtcaaatgggttgggggagcagtgttttttccaaaataatttaggctcattttatcattcttatgttttccctcaaagctctaagcagtacatcgtcctaagctgaatttaacattgctccagaatatatatttatcatagttgtacattcagacacaatatgcataaccttaaacagccaggatgcacttgtgaatcaggggcttcccttacttaatcctgcgcaagagaggcaaagcaggcacgtgggtctgattccctgtgcggtctccttcatgaggagcatatgtgaaatacctttgaaatacagagaagattgagacagcttttctctttctggtacagttgctttcctgctgaattaaatgagatgaccctgtcttcaacaaataaatgaatggaggcatttgaggcccatttaacaaatgcacaaaatatgcctgcctctgtttttcctcccttcagagctttagcctccagcccacggagttgtgatgatgaagcccacctcctaagtgggactcagctcagtttctgtatcatatttaaaacagagtatgttgcttatttctaaaattgcatagcacctcaccactaactattttgctgcatagaggtatttcatcactaagagagctatatagagaaactcactcaaatcctgattcatcattgttgatagaacttaactattgtgtcatcatcacctgacatgggctgcagaagctccaaggattgctatagatctcaattgagacttctagtaacagagctagaaaggagccttttaaagtgtagccatgactctggtcattaggtatatgcatgttcaaatattcccttacgtgcttgttttcgctttcataacaatttccagggatgaaaacttagcagattatttttataatgaagagtattcaaattaacaatgtgtatccaccagctaacaagttttaaattccacagaaatcagcatcacaagcatagtaaaatcaagttttcattctttcctcttctgccataatgacttcattcaaggcctagtcccagaccaagtgcatggaaacgatggctcatgtctctcaacatttgcccaagggaatggtgcctaccttgcaactcagcgtgatgtcacctttattagccattctggtgtctatacaaaatatttgctccccatttcttcttatcgatgcctggtcagcaacaatcatgtaaataagtttccattcttttgaggaagataacgaagtcagcgtttttcagaagtggtgcctaggaagagacaaaatccaggacacacctctagttcaggtaacactgcaatatatttcaatttcctgctgcgtgatggggttattattgaagagggaagtaaggtatatcattcacagcacattgtccccacctggctcaagcaccacccattccccaggtgggctcaatatgctacccccaccaccaccaagataccaaggctgcaaatgaaaagtagatctcagccaggcatgatgggtcacacctgtaattccaacactttaggaggccaaggcaggaggatcacatgagcccatgagttcgagaccagcctgagcaaaataatgagaactcatctctacaaaaaaatttaaaatgagccaagtatagtggtgtgtacctgtagtcccagctacttgggaggttgaagtgagaggatcgcttgagcccagaaagccaaagttgcagtgagccaagtttgtgccacggcactacagcctaggtgacagagcaaggccttgtctcaaaaaaagaaaagaaaagaaagaaaaagaaagtaggtctctttgcagaaagcctcaggccctgaacttttgtgtcatcttctcattactcaagtctaattccctacatctcacttttacacacagatcatttttttcatgtttgttttgattgcccaccctggaattctatttctgcactaccctttaaaagtgaaagatcaaatctaacgctctaatgtgggaaagcattccctctatttctacaagcttatttacacaaaaaaataagcttgagactgatcaaaagctgaatttctaccaaataggaacttactttttatgccgtaaattatcaaggccatctcaaggcagaggtgagtttagcatctcatgctttatgctcctttcttctgcacctaccagatttttattacatgtgaaattatatgaacataaaccccagggaaacattgaagatgagtgtgccgtcacaagtgacgaggggacagatgaacagggaagagaaatggggcagcagcactttagagtgacttacttctctcttgttttctcctccctgaatcattttctagaaccagtattgtggcccctaaaatttggggcttaggtcagtcaacttaccaaagttcatcttcctggtgatgaaaggactttcatcaaaatcccagctactttttattcgttcccacattttgtggattaagaaactgagaaccagaatttatagagatcactcaatcaattggcatattcccggatcacaacaaattgataaaattcttgagaaccctctttctaatacagattgactataattttgtctttcatttttagttctcttattttgtctcatgcactgtggattatctggtttactgcagtccttacctgaatagatgtcagtgttttgatcccattgttgtattcccctaaaacacgtcaaatgaaaaactggacactttaataggtttattgttagcactctctcatgctgatcaattctcaacacatgcagttgtaggattaggaagacaaaatcctttagaagaagctatgaaacctaatccttctgcatctggatcattttaaactacaagttgtaagaggaatgagcatctctggattctagttatcagtgcagaccagatggaaggtctttatgaaatctggtatgagaaggaaagcattttatagcaagaagaaaatattttgagaaatagctaccagcagcagcagctagcagttctaaaactctcagatcctcctaatgaccccattagggagggaggaagggagcaaggaaggaaggaatgaaggaaggaaagaagaaaggaaggaaggaaggaaggaagggaaggagggaaggagggaagtgttataaatattggtcagggaaaagttttattattaatgacagattaaataattagctactaggaaaattcaaggggatacataaaaatgccattagaaagaataagagaacccagtaaggtggctagctacaatagcttgcctggttagcgacaatataatcatagggatttatattacgcttgtacactgttgggcagaaaacatgcctgagaggtataaaagatgctgttagcatccaagaaaaatgggaaaggaaagcccacctcatctgaggaagatggaggaagaagaacctacagaaaaggattccacattccaaactcatccctctgaattcagtaatatttatccttatatgatttctgacagtgtagtttgtcattgtaattaattctttcctgtaagtaaacaagaattgtatacttacttaagtaccttacattttaaactttattacatagtcctaattttaatgttgaactctgccctagtcaaggaagtatttgttacctaacacaagaatttgatatacagtcatccataaacactatcctaccatatagttcatcataatttaacattcaaagaaagaagcatgatttcctcttttattatgctttcatttgagccattttaactttcttaccattctttccttctgaacctaattcaattccttacacaatgctctaaaaaatcaaggattaaatatgtaacttaatttataattagcaaatacatcatttacaagatgcattcatattggcaagcatattttatttcatagattgtaaactggtaaaacaatgtaatctcctcaccctctctgcaatacagtaagcctgtttctaagaccatcaaggttttactttatgtccgaggcattggagaaccagactgtactgaccccagggtttggtgacttacatataaatgaagcatcttaccaagaagggatgaaaaatgactttagaggaagcaaaagtctcaaagctcacaagacttgattactttcagcttggtgacagaggcaatgctcttgtgatgcagatggagtaatttctccagcacaaaagatgtccagccgggtcccattggctttgagataatctctcacattgcattaagtgtactgagtaccctttctcagacttatgtaccattagcatgcatttaattaacagttaatgattacatagtattgttactattaccacatagtcctgttatattaaaatacatgaaatttgtagctatgttttgcctgtttagtaaaatgagtctgaatctaagggtgagagggtctacacacagccaagaggatggggtattaacccaggcctgtgtgaagatatttgcatctcatggaatgctctccagagaacaaactgacctaccctgtgcatgtcagctaagctcccgccagcttcctcagggcttgctgaatgtacagtgagtgccacagtgccagcgtggcagtgaagcacaggcccaactctacggacctggggtcagaaggcctgggttaataccccattctcttggctgtatgagctgcatggtctgtcatcgttacaatggggacaataatacatgccctgtctacctcagcctcctttcagggaagtttctcaaaacagaatatgctattgtgattcattgtcacctgtgatgtcaaactgcaccttgtgttatactactagggggtaacacagcatggggctcaagcccaagctctcgagtccagaaagccaggttcatatcccagctctgccattcattaactgctttcacatctctaaacctcagtttcctcatttgttggggctcacataacagtactatgtcatagggctatttatgaggattaaatgtgtgtattcattattgctaaataataaattaccccaaaacctaatggcttaaagcaacagatttttattatctctatgatcatagttccatgggttgggaatctgggtatggcttagctaggtcctctggctcaggtctgtcactcacaggctgcaaagtttcagccgagactgcagacatctcaaggctcaactggggaaaggtaacgcttccaagctcgctcacgtggctgttgacaagcctcaggtcccagctggctgctggctggagacgttcttttgctaccacatggacctctctatagggctactaacaaaacagagtgcttcatgcagatgttgcagcttgctgtccttggagcaagggctaagattgaaagatagcaaaatagaagccaaggtctttttgtaacctgatatcagaagtgatatcccatggcttctgctgtgttcctcattagagacaagtcactagtttcagcctaattcaaggggaagggattacacagtgggaggaatacctacaggaaccaaatcattgagagccacctgagatactgcctgccacaatataagacatcagaagctgtttgataaagactcaattcagtatcacctcgtggttttatctcatagtaatgttctcagactgaaattagataatctgtcaaagaatttgtaaaatataaagctctatacaatatcaagattttattagttttattaatgctgagaatccagttccactttatagatagtgatataagaacagcaaatcaatgattaagagatgtgaattttacaccttgctgtgtgtgtgaccttggaaaagccatttatttgtttcataccttagttctctcatgaaagtgatgataataacagacttaccaggataaaatagataatagacagccatgcagcacattgacaatattttggtcacccacaaaccacatatatgacagtggtcccacaaattataatggagctgaaaaattcctacagcctagtgacatcatcgctattgcaatgttgttgtagcacaatgtatcgctcatgtgcttgtgatgaggctggtgtaagcaaacctgtgctgccagttgtataaaagtatagcacatacaattatgtatagtatataatacttgataataaacaactgttactggtttatacatttactgtactatactttttatcattattttggggtgtgttcctacttaattaaaaaaaaaaagtgaaaagaagtttaactgtaaaacagcctcaggcaggtccttcagaaggtatcccagaaaacagcattgttattacaggagatgacagctccatgcatgttattgccccgaaggaccttccaacggacaggatgtgtaaatagatacagtgatactgataatcctgagcctgtgtaggctaaggctaatgtgtctgtatcttagttttgtttgtttgtttgtttgtttgtttgagacagagtctcagtcgcccaggctggagtgcagcagcacaatctcacctcattgcaacctccgcctcccaggttcaagcaattctcccacctcagcttcctagtagctgggattacaggcactcaccaccatgcccagctaattttttgaatttttagtagagacgggatttcaccatattggccatgctggtcttgaacccccgacctcaaatgattcgcccgcctcagcctcccaaagtgctgggattacaggcgtgagtatcttagtttttaacaaaaaagtgtgaaaaggaaagaaaaaatttaaagttttaaaaatagaaaaaagtttataaaataatgttataaataatgagaatatttttgtatagctatacaatgtgttttaagctaagtgctattacaaaaagagtcaaaaaggtttttttaatttaaaagtttgggggttttttgttttgtttttgtttttgtttttgtttttttgagatgacgtttctttcttgcctcccagactggagtgcagtggcgtggtgatcccagttcactgcaacgtccgcctccccagtttcaagcaattctcctgcctcagcctcccaagtaactgggattacaggcatgtgccaccatgcccagctaaattttgtatttttagtagagatggggattcactatgttggccaggctggtctcaatctcctgacctcaggtggtttacctgcctcggcctcccaaagtgctggtattacaggcatgagccaccacacccggcctaattaaaaagtttataaagtaaaaaagttatagtaagataaggttaacttattattggagagagaaaaaatggtttttacaaattaggtatagcttaagtgtacagtgtttttaaagtctacagtagtgtacagtaatgtactaggccttcatattcgctcaacactgactcactgactcacccagagcagcttctaatcctgcaaactccattcatgataagttccctacacaagtatcccattttttatctttataccatattttcactgtaccctttctacgtttagatacacaaatactattgtgttacatttgcctacagtattcaatacagtaacatgctgtctggctttgtagcctagaagcaataggctatgccacatagcctaggtgtgcagtaggctacaccatctaggtttgtggaagtacacatcttgatgttcacacaatgatgaaatggcctaacaatgcatttctcagaatgtatgatgcatggctatatataaaattatgctgaaatctaaaaaaatgagatgatggtcataatgacaatgatgaagatgactatatgtttcagcttctactccatggtcctttgaggacaactgaagtaactagatatgatttttgtcagttgtgttttaagtgtatgtatcaaatccagctaccccaagttttacaataactttatatggtttaatcttatcttgctgaacacattagatatgctgccctgaaaagtggcttgcaaacagaatttttagaaactgaaccataattaaaatgcacagaggccgggcacggtggctcacacctgtaatcccagtactttgggaagccaagacaggcggatcacctgaggtcaggagtttgagaccagcctgaccaacatgaagaaaccctgtctctactaaaaatacaaaattagccatgcgtggtggcacatggctgtaatcccagctactcaggaagctgaggcaggagaatcgcttgaacccaggaggcggaggttgtggtgagccgagatcgcgccattgcactccagcctgggcaacaagagcgaaactctgtctcaaaaaaaaaatgcacagagaaggtttccatgtatctagtggaattgtacaatgcttatgtgatcttgtgatatcattaatattttgtaatataaataattatcctcattattttaattttctggcattgtagcaacacctgtataaatatttatagttacttaagaactcacaaaacaaccttttgaagtaggcaaataaaaccaactcttggttatctcaaagagttctttttgtttgattcttgtgttatctacatttcttctctcactgtaaattggcataaatttggcagatacaaaacaagtaaagttcaaactcctccactcaaccactttaagggattttttttcctgcttataagtatatcacatgttcattgtagaaaatttggaaatgcagaaaagtataaaaaatgtagttaaagttactcttattgccaccaccaagaggcagccactattgatactttgatgaatttctgccttagtgctttccctctctatagggagaaaagagtggtttctttttcaatgaaatcaggagtatgttatatacttttcttgtgttctgctttctctaattaacattattttttaaatgatatttccatttattgattcaacaacataaattagtaaatattgactatatccaaagtggaatttggatgaactgtaagaaatatagttaataattgaattcagattttttaaatcaattccaacaattgtgaagtagtttcttttcctttttttaaaaaattttactttaagtttggtgatacatacgcagaatgtgcaggtttgttacataggtgtacatgtgccacggtggttcactgcacctatcaacctgtcatctaggttttaagccctgcatgcgttaggtatttgtcctaatgctcaccctccctttaccctccaccccgcgacaggccccagtgtgtgatgttcccctccttgtgttcatgtgttctcattgttcaactcccacttatgagtgagaacacgtggtgtttggttttctgttcctgtgttagtttgccgagaatgatggcttccagcttcatccatgtccctgcaaaggacatgaactcattcttttttatggctgcaaacattatctatttaataagtttcacatgtaattattatttgaaaacatcatttctaataagtatataatattgttgtatggatatactatatcttatttaaccagtcattactattggacttttaggtggttgtcagtttttatactgtaaaattatagcatgaaaagaaaatttttacataagtctttgtcattcattattctagttatcttagtaaaagtagcaaaggagtccttgaagtcactagggggaaatgaggtttggtaatccaagtataaatatatacaccacagtcttctcttccctcttccctaccacttcctctcacctcccactggcagaaatttgcaggcttttaatgctggaaattgctgaagtaacaatctaattggggtggccatctgtcgtttttggcccatatcgttcaggtcacactgaatgcacccttggctccaagagtgacatgggacccaggcccatccaaacatcttgttctccagggcactgtgattggttcagggataggccgtgatccaagcagaccaattggaatcaatgaggctcagttgagaggtgttcaggtgccatcacctacattggatttggagatttaaggatacatgccaggaactgcagggacccaacataaggggagtgcctcctgaggataaaactttacatggaggaaggaagagcccagagatggagaaagattcttgggtatattatttaagtttctggatccacctgtgcctgatctacacttgacactgaagtttcatgagcaagtaaagtctccttctcacttatgccaatttaagaagatttctgtcatttgtcttttaaaaggtctttaataatccagagatttttaccctctcaattgatgaaaatgagttgtagttaagacagattctggaactgaatcctagttccatcactgacagtgtaacgagggaaggttatatgacctttccccagtcagcttccctacctataaaatgaaaataatgctaatacttatcacctcagagaggtttttgcagggttaagtaagttaatatgtgaaaaagtgcttaaaacagtatctggtatattttaattactacgtaagtgtgtccctgctgctgctgctgctgttgttattttgaaggcagaaagaaaatgcaggagagtaaatgacctatttcactcatgcagagatttagcagccaagctaaaattcaaatttaggtcttctcttttctctgcttgttgttctttctcaagagctaagcctatcgtcatctttatgatatatttgagtattaagctttcagaagtttccatccacataattgaacatttctatcaaaagttttgaggtagaccaggaggccagaaaatagatttaagttactagcaataaccagatgctactgtaggattataggttatcacaacttgtaactaaaaattatgatttttattataataagtttaattacatttatttaattttaattaaaattaaaatacattttattattataatttctactttaacaagtaactatacctttcactgtgttttatttagcacctttcacagtgttgttgtcttttttaatataccttcctattaaaccagttgctctttgcagaatgcttgaatcatttggctcttggttagtaggctcccgttacctaaccaagcactgagtgaacgtatttactggggaggcagctggtctctcccaaatgtaaatcagatttcatcatgtctggcttggagagaacgtggcatatggcaaatgaagacacagctgcatagtgaaattttccatcacaagttagtctaatacctgaatgcagagtgaataaaacattttctaaacaagaatattatgttcaaattcataatcattgttaaatattaagagtcaggttatttcccttgaattatacaaaatttcactattcttgaaaaagtacatgttatcttatatttaatgtcatactattcacatccaggctgcctttcaacttctattatttaaaaatattttcagatatctacattgcctgttattaaaatgcaaactgttctttgagtagagaacctttgtgtaaggccttacaaagttctgatagagatgaagtgcacggaaggaatgacagtgtggtgggaaggtccatggccttaggggaatgggtgggagcctaagctttggagcagttaggttggaattcagacaaagccctgccacttctaggctgcaaaggtattgaacaaggtacttaactaccctctgcctcagtttccttatctgtgataagaataatatcatgtaatgataatacaaacatcataggattgtcagaatcaaaatgagaaaatgtatgcaatattcttagcatagtacctgccacataataagcactcaaaaataataagacctgcttcatcactggctctaaagttgtgtccaattggtttcataaccctaagaaggctatcaaatcttcctgggcctcagttttgtcattagatgagtaaattggaccaaattctataaaaagtgcctttgggggttaaaatgctatgacaatgcccatacacattggggtaaaccaaaaatctataacaggggcaaacttgggaagattttttcaaatctgtttttctacactgaaattgagctgcatcccttctccaaaggtgatcatcttctctaataataaagcaaggtttgtctatttttaactttttattgatccagtgctcagatttttcagcaccatttggggaggagtgttcaatgcctcattgcagaaccttccttgtcatgatgattttgataatattattgacattctttcagattccatagtgagtctttgtcatgatcaaagggctcatgatgctgataacacaaacaagagtaaccagttcaagaattaatttggttaatgaggatcactaatacggataatttcttcctaactgttttggcgggatgcattatttggttgagtgtattatcttgtctacactgatcaagctagcttgaaactcttcttatcagcctttaactacgtactttaccaacacagcctttgaaatatttgttttcttttcatgaagagcttttaaattttttgcctagattccaaagtaagaaatcaatttaaatggcataactttcaaactagacttctgaaagactttatgcatcatcagtaaatctaaattgatatttttctttaaaagatgcaacttttctatttcctatgtaaataactgtgactctattgatttataaactccaagaacaattaccactagggaaaaagacaggataaaggagcatttgttgtcaagcagatataatattttgaactgatgataatgtttcccttacaaaacatgcttgtattaactgatatttatactcatttttgaaaactgaattacagatttatgaaggatatattcgaaacttaattcactaaaagaaaaaaatatatatgtctattgaaatatcccctaagaagcagaaaaatatttttgttctagtagtataaatgaataatgcaaataagaatgtcacctgaattttaagtaacacacagtatatttggaccccagattgacaattggcaacagtaccagaaaataaactagaagctagatgcagccaggccttggcaaatatatttttatactgttgttaagaaactcataataactgcttcctcactgatgtgaactttccttagttgacactctcttgattacaagtacacgatgcctactttaaattatccttaatcatgaagggaatttgttagaagatgccaggatatttggtgaaactcaagagctagagttagctactaggaaattatcaggaatctagaaccttatttttctcttcccttttttctctccaagactggctttgaatatttctacacacatgtggctaaatgtgggtgtcccatagctccttagtttcaatttcgagattcaaacaactcacagagaaaaccaacaagcatctctcactcacagttcaaattcctagaaaaaaagggagtttggcccagctatagttagctgtctatccctagcccatcaacaatggtgcaaacataggtgctgggaatctagtcttagcaggaggggaacagtatgcagaaaaagggggatctgtgttgtacagacaccccaaaaaagttgtcttttcttccttttggcttacacatacacacacacagacacacacacacacacacacacacccctaccattcttcccatttattaaaaggtctccctgccatatatgacttaaccatcttacactgaactacactctcattcacccccttcctaaaggggataatccaatcaatcatatctagcaactgaatcctaaaatgtcatcaatgggcccctcttctcaaagtgaatgatccccagaatagtccatcttttctgtagattaggcttcattttgttcagaaaaatagctttctctttttattctgcaacataatgattgaatggtaaaattagaaagttatcagtaaaaccacaaacattcccactcaaaaaatgattacaagaagcaaaaatcttcacagcaacatcatacattggttaccagaccagagaatatattgcatcctgcaagacaaggattgcaagaaaggtgaagagtaggataaataggttttatgggcttccattattgttgggatgggttccttcctaaatcaagtacttcactacaatataatgcaaataaagtgaacctctctgcatgctgccttgactgactcagccaaccagtttcatattctttacatagctttgttaactgtagctctctctattgatgcaatttctctcttagtcgagatccttttggttgtgagtaaaaacatacacagatacaaaaccacagactttaagttagcttaaggaaaaaatatgttgggaggagtttactggaagggttccaggatacattaattcataacaaatgaccccaaaacttaatggcataaaatggcactctttatttaagtcagttttggagattatctgggtagttttctctttatttaagtcaattttggagattgtctgggtagttttctctgctgagatttttcctgcctctgcatgagctggcaggtcagttacaagccagatgatctactgtgttctcacatttctaagggtcggcaggctgtcagctagtgcaaaggaatcagtggttagaagggactaggccatgtggctctcaacatccgggatgctacactaggcatcttcacagggttcctaaaagtacagtgaagaaagcagcaaagtccttgagactcaaactcaaaactcacatgattccatttctgtcacattctattagtcaaaataattcataaggtcagcccagactcaaggaacagaaaacagattgtattagtctgttctcacattgctataaagaactacctgagactgggtaatatataaagaaaagatgcttgattgactcacagttccatagtctgtacagaaagattggctggggagtcctcaggaaacttgcaattatagcagaagcaaaggggaaacaggcacatcttacatggctggagaaaaagcaagaaagtgaagggggaggtgctgcacacttaaacaaccagatctcgtgagaactcactcactaccatgagaacagcagagggaaatccacccccatgattcaattacctccaacaaagcccctcctccaacattgggaattacaattcaatatgagatttgggtggggacacaaatacaaaccatatcatagattcacctcttgatggcaggagctgtagtagggacatttttgcagtctacaacaagggatattatgaagaagtcaaagataatttgtatagccagacaccacaaggggctagaactgtgaactgtaaagctggcagagcctgagatatttccatttttattcaggctgtctgtctgcctctcatcatatggcctcttactctgcttctctcactaagacatcttactttattcaattactttattcaacttactttattcaaggtatgtatataagaccctagaggcctgccccacaaatccccagtgtgcatgtcttcagttcaagtgatctgctcagacagctgaatagtatctcttagcaccaatttcaattcccaaaacagaggatttgattgtcccagatttggggcagtgattcatcccaattcatccactatttctggatggggagccacagaatagatacgtggttactgtgaggcccctctgcagaagagagcggtgtgggacccttctcagaggatgagagactcaggagatgctttctatcacagaatgtaatggcaaagcccgtatgccctgaaaaattcaactctccaaatgaagtcagtattctgttaccaagtcagtgccaggaaaatgcaagaaaaattgaaaacaagcttgtcattttcttctatttttttctgagtctgaagtgcccgtagatactcttaattcttctagaaagcttgaaagcaatatttaatggaagtcaaatttggtctgcagcagatttctttctcatttgattttctccttcttatcttggaaacaacctctaatgagagaaatattccagagcaccatctcaagatgtatctgggaaaagaacccattgtaccccagagcaaatcgaccctctgctccctgacaatatgcttggttttcaacagcttccctgatcccagttcttatgactttaccacacttttctacacttcccagaggttcagcaaggcttccgtctccctgccggtcttgtcagggcaatctcttcactggcaccatggcttattttctacagaaccattgaaagcagacatggttcccatgcagattatcttcccatttgcacttaccaatcatgtgaactcaggcaggtccacctccctgtcagcttgtctcctgcaaaatttagacttcatgtattttctgtcactgctattctgtatgtttgttatcagatcaaatgagacgcctgcatgcggtagcaccttaaaaacgttagaatgctctgtacatgtagagaaatggaacttctctcacagatacttgatagtgagataaagtggcacgggtcatttcatgtccagtgtcatcatacagatgtaaaatcccaccttggaaatgtaggtgaccacatgtagaattttacctctgcctgctcatgagaccctgtgcaaaggactcagctaagtcatgctcaggcttctgatccacagaagctgtgagataataaatttatgttgtttaaagctgctaaatttgtggtaatttgttacacagcaatagacaactaatacagtgttcaatctcaaatgtaaaataacattttacataacagaatgctatgtgtaggcttgagtgagtgagagagagtgtgtgtgtgtgtatgtatgtgtgttccaaaggaaacgtattttaaaatgaaatacattttaacatatggttttcaaaaagctgagaaactgatgataaatttacacttgttgctgcaacatctcaatattgtaaaccaaaaataaaattctaagacccccccaaccaattgactgaaaccccctctcagtcaagggcattccaaagtaaacctgaaaaactagttcaggccatgatgggaatgggggattagacacacctcattatacccttctctctttggaattggggcacaatggaccagcattaacactacaacagagatctcaagactgaccaaagagattctttgtggcaataaggtatatcacaaaatcatagatagcaggccctaaaagaaatagaaagtattttaccctgaaatatatttctttgatgtattttaaaatggccctgcaaagctgtctcttgtgggagaaatctacattctataaagaatcctcttccctttccaggtctttttctgatcccagaaagactaactaaaagtctggaacctttaaaagtctgataagaaatatttaccatctaatctctctgaagcctgctacttggaggattcatctgcataataagaaccctggtctccacaaccccttatcttcattcagacattcctttctatattgattccagttctttagataataacttaacactttcaaccaattgccaatcagaaaatctttaaatccacctataactggaagctgccctgccaccatcactgctttgagttgttctgcctttctggaccaaaccaatgtacaccttatatgtatcaattgatgtctgcttgtaacttctgaccccctaaaatgtataagaccaagctgtaacccaaccatctgcgtacatgttctccgaccctcctgaagctgtgtcattggcatgcccttattcttgacaaaataaacttctaaattgattgagaaaaaaaatttaaaaaaataaaaacctgattttcttggtcagagctgggctactacttgcttgccatatgatcttgcacacattatttatggagttttttatgtttcactttctgttttttaaataagaacaactccactaacttcagagtcttatgagaataaaatgataaaaggtatgtgaatatgcttagcatactatttggccatgctagaagactataaggttaggttttgtttatttgtttgtttgctcctttcttggtgttcactgggttcaatggctaagttctattacatgttaaccttgtcgtttagtatagaaaacaatgtgagatttagcatgattattgaaacagcaaatcttcagaaatccaacaaacctatggcactcaaacagcttagtaaaacctacccaacaaaatttaagaagtcttggaagcagatggtttggggcatctaggctccagcccaggggcatttttgctggcatttgtgagacttttcaaaaacaataagcagtcaacattgttcaaggctcattttttccctgccttctgaggtgactacttgagcaacatctttcagataattctaatctaagaagaattttttattttaaccttttaaaaaggcaataaaataagacatctattttttctccaaatagctttgtacgataacctctatttattaggacatttgaaagtttcttaccatatattctagccaaggccatcttttttttatgaaacattgttagaattaaatcccagaatttcagatgagctttcccttacactgtcatatttcaccttacctcttaacttttaagggactgtccatgaatacctgagccccaacatctcagtcacttggcactggagaaaaatcatagtgccacccacctatcttctgaatcaatgtatctgaatgtttaatattttccatttgttttacaatttcttacaaaataaattattttcccattgaggaaaagaaagatttttatgcatttgcatgaaaaggtttcaaagatattgttaaatggaaaaaaagggcacagtaaagtaaaaaatagcttgcatatcgagatctcatgtgcatggaaatgcatgggcaaaagcctacaggagcacagtggtggatgctggtaacctatggaaggtgagtggagtgtgagcagagagggggcctgtcacctttagtcatatatacttccataatagtaaaattttttaaactcaggctatatccccacactatttaatttttaaaattgtttttaactgggcgtgggcaggaggcatgcattccttgaccaatagaggcatttttttttttttttttttgagacagagtctcgctctgtcgcccaggctggagtgcaatggtgcgatctcggctcactgccagctccgcctcctgggttgacaccattctcctgcctcagcctcccaagtaactgggactacaggtgcccgccaccatgcccagctaattttttgtatttttagtagagacgaggtttcactgtgttagccaggatggtctcgatatcctgacctcgtgatctgcccaccttggcctcaatagaggcatttttaatttacgagcccatgggagaagcccatgtgcctatactcaaatgccagctcctcacaatgaccccaaacattctgtctaaagtgccctctcatcttccagtctgttcctgtttctgttttttccctcatgatacttgctacgatccaaaattaataagtatctgttggcctctgttttctcccagctagaatacaggcattatgagggcaggagtctcatcaatcttgttcagttttcatctccagtgtctagaggagaatcgagcattgagtagatgctcaacaaatatttgaataaatataagaatgaatgagacaaatgcccttgtgccattattgtctgctataaaactctgaaggagcaggggctgcaagcaaaaatggcagtgggcccaagttttacatctgcttccaaagtactatttcttatttgttagagaagacatttgtttcaagagatctaagagaaaatttgcctggtggaagatcctagcagccccagactctgaacaggaagtgtctaccaaccagatattggcccagctcccacacagcataagacaatgtattaatcagggctctccagagaaacagaaccaattgcacgtgtgtgtgtgtgtgtgtgtgtgtgtgtgtgtgtgtgtgtgtgtgtacagaaagagagagattgatgttaagaaattggctcacacagttgtggagcctggcaagttcaaaatctgcagggtaggcaggtaggctggagacccagggcagagctgatattgcaactcaagtctgaagacggtctagaggcagaattccctcttccttggggaaactcagtcttttttctcttgaggccttcaactgattggatgaggcctaccacattgtggaggataatctgctttacctgaagtccactttgaatttaagtgttaatctcatcttaaaaaaagaaaaaaagaagaagaaaaaacactcagctgagcactgtgactcacacctgtaactgcagcactctgggaggccaaggcaggtggatcacctgagctcagagttcgagaccagcctgggcaacatgatgaaaccctgtctctacaaaaaaaaatgcaaacgttagccaggcgccatggcacctgtatgtaatccccagctattcaggaggcagaggcatgagaaatgcttgaacccagatggtcaaggctacagtgagtggagatcctgccactgcactccagcgactagtgttttgactaatctgggtaccattgcctagccaggttgaaacacaaaattcatcatcatgggcaggatgacggaacctcagctggagccttagctgtgtaggtaacacagagagtatcctgtggtgaaaaaattagaaacagacattgtgtgagaaagaaggggcaagttttgtgtaacatcctgacaaattttgaatctctgttaatcctcttttatgcaagtatcagaagatcacttcatgttcagccataggagccctttcctcatagccccatatcagccaagcgcatatagataaagctgcaggcaaagataaggcgtctctgaatccccagctgtgtctgtagggacactcttccttagtgccactatattcctcatactagtaaggaagtcagccaattctactcaatgtacaagtaagtacattgaaatgcagactatctaaataagcaaactgaagaggcacactgggaaagttatccagataattcaggataaaattcagcaggtgtcttggtctgttttgtgctgctttaacagaatagtgaagactggatgatttataaagaatagaaatgtatgtcccacagttctagaagctgggtaaccaagatcaaggtgccagcatgtagtgactagtgagggccttcttgctgcaccatcccaaggcaaaaagtggaaggacagaagggggatgaatgctgtgtcctcacttggcggaagtgcagaaaagagcaaacccactcccataaccctttttatactgacattaatccattcataaaggcagacccctcctgacctaaacacctctccaaggccctaccacccaacactgttgcattggggattaaatttccaacatatgaattttggggacacattcaaaccaggcaagtttgaaaagcttatatttggggtttacattattccacctggtgaacttcaccagttagactccatttatgacacagctcaggtgaatgttctgttatcccggttgttcaatcaagatccattgagctgtagtgggtgggggaagtgaatcaggagcaaacacttcaggaaagtgaggttaaatgaaagaaaggctgagctaggcacggagaacctgaattctagattttaacacctctcttgatcatttgggacaagtcacgtaaccctaagcctcagtttcctctctgattctcctttagccctatagtttcatgggatgtctaatctcagacactctgctggccatgtggcctcagatccctctcctaatgcctaatatgtgttagcacccttgtgctttcaaatatctgctactactgctagttttatttctaccacttaaagaatggaaaacccatatttaaaaaaaattgatttcccccacaatagtgtgtctgaatacagattctgaattgctttacacatatactgtatgtttatctaattataagtagaaaataatattgtgccagtgataaaaatgaagctaggaactatcaagagagcctggtcctatttccaaataccattatatgctttagtattttggtttcaaatcagcttccaatatttggggagtcagtttttcttttttgatattttttctgctcaactgtttcagaaaatctcttgttgctatggaagtcaaatgggatttttcatctgttttaaaatcatctcctcatgcctttacaattaaaagtcatagctaattataatgcttacctactgaatgtggatcccatattaaacaaaagaaaatatatgttcataatgtcaggttcgtaagaaaaagaatttttttaatttaattattttaccagactttaagtctttcccattcttacacatcccatttgaatgacactaaaatgtataaaatcaattatatgagtttaatttgcccaagcttggtataaaattttattattcccttcctgagtatccggctattctaattaattttctcctccttatcagcggatttaatgattcacttccatgcccctcttttgccaagtgcgtcagcgtgtattgttagccagaggtgtctccatggctgttaagaagctctgactcggtgaagaaacagaagcagtgtgctgagcaggagaagagggatgaggtcatgcctttgagcaccgactataacctttatgttgctcttggtttttgtaatgcacacatatgcacatgcaaatatacatgtgcacacaaaaatgcatgcctagctatatgaattctcatgtcagaaatgagtggcgagtgaagatcagaacagatttcacatttttaacctagtctaaattcagctcctttgcagaacttcatctgagtaatcccttttaaatctgagccctccagttactccagattttcttagcacttagttagttacgtgcatgcctctgctgtcatagcaaagtcacaggctgacatccacagcagggaagataagtaacaaatgcatgaacttgtggcacaagatcaagcactgggtgtacagctcatgactggcattgaggaacatggtaaaaaaggaagggaaataaagcaagtaagatttttgtttgaacattaaggagaattttttggttaggtacagtggaacagtttataaaatgtggtagtatgatccccaatcctggagcacataaagaagaaaataaaaaaacattttcctggagttgcttgggtcagaaatgtcagagatgcagtgcaaatcatcttatcagctatttgagaatggtcagatgtagacatgaagagattaacataattattcattctataaatacagtcatacaccacataataatgttttggtcaacaacagaccacatatacaatggtggtcccataagatggagctggaaaattcctattacctagtgccatcctaacatcatggcacaatgcattactcatgtgtttgtggtgatttggtgtaaacctactgggctgccagtcatatgaaagcatatcacaggctgggtgctgtggctcacacctgtagtcccaacactttgggaggctgaggtgggcagatcacttgaggccaggagtctgagaccaacctgcccaacatggtgaaatcctgtccctactaaaaatacaaaagttagccgggtgtagtggtgcatgcctatagtcccagcttctcaggaggctgaggtgggagaatcacttgaacctggaaggcagagattgcagtgaaccaagattgtgccactgcactccagcctgggtgacagagcgagaccctgtctccaaaaataagataaaaaataaaataaaaataaaagcataccacatacaattatgtatagtacataatacgtgatctctgttactggtttatgtatttactacactatacttttattgttattttagtgtgctccttctactcattaaaaaaatgttaactgacaaacagcgttaggcaggtccttcgagaggtattccagaagaaggcattactattataggagatgacagcaccatgcatgttactgccccaaagaccttcctgtgggacaagatgtggaggtagaagacagtgatattgatcattctgaccttgtgtagtccaaggctaatgtgtatatttttgtcttaatttttaacagaaaaatttaaaaaataaacaaaaaaatttacataggaaaaagcttataaaataaggatataaaaaaagaaaatatttttgtacagctgtacaatgtacaccactgcacctggctaacttttgtatttttagtagggacaggatttcaccatgttggtgtttttttatcaagaagttaaaaaaatttaaatacttataaagtaaaaatgttacaatgagctaagtttaatttataattgaagaaaagaaaatattgtttataaatttaatgtagccttagtgtacagtgtttagaaagtctacagtagtgtacagtaatgttctaggccttcatactcatccaccactcactcgctgactcacccagagtaactttcagtcccacaagctccattcatggtaaatgccctatacagatgtaccatttttttatcttgcatactgtatttttactgtacttttttatgtttaaatacacaaatatcattgtgttacaattgcctacattatttggtacagtaacatgctatacaggtttgtagcgtaggagcaataggctatatcacatggtctaggtatgtagtaggctataccatctagatctgtaagtacactgtgatgttcacacagggacaaaattgcctaacgacacatttcttagaatatgtccctgatgttaagcaatgcaggactatacttattaagcacctattatatgcccaactctctgttaggccctggagacacaataaacagactctattttcaaagcccccatggtcttaggggtaggacaaacagacaagcaaaaattactctacagttcaggacatcattctagaaaaccctagaagagaagttgcactgggtgctatggagaagaagagaggcaccttccctggagcaacggtatgctagggaagtcttcctgacaatatccagtcttctagtttgaaaaacaaaatcatcatgtgaccgtgaagaaagctcatatagccatttgcatgactgaaaaaatatgcgttggaatcgtatctgggggcatggggcagattgcattactaacacataagacaaatcaggaatatttacaattatccttaaaaatcctacatattgctcataaagtactaagtgcatgaatatgtgcatagttttatgttgtggctatatttagtaagtaatatatatgcctaaatatgccatccatgcaataaatgtaagaatcacactctgtggcaagatgctctcagtgtgagacacaaggaaaatgtgatagcaggtgatatactcatttagtgatatagcagaactgtctgcagtacttaaattctttctctctttctctgcctttatattttctttcaagcatgggtggttacatttgtctaagttaaacctctctttataacagtaaagttgtaaactttgtctaagctgtaaacttctccttacaacagaaataagttacagtttgaacaaagtttttgaaaattttttaaatcatcttaaaataatgatccacagtactgaagaactcaatgaaagagtaattacaaattgctaatgtttattaattcttaaggttccttatattttaatgccttgcaataatgaattatttaaatcataggaattataacttgcacataaaattatagtcaataattttaaattaataaatgaaacaacatagtactagtaaaagaaagaaaaaggaacatatttagagatatattcttcaaatttattgaacttcattcacccacagattttgttgttcgagctgttgcttcagaaccaaatctgctcaatgaatatcaccttctgcctcatttccctcatctttataggtcaaattccctatcactgcctccactccatgccatatgtgggcttccagaccaaatctgacttgagggactcagcatcccggggctttccacctccttcactgaagccacctgaggggctcctccgtccatcctgggcatgctcactgctcctctgacagagcaagccattgacttgaagcagttctcagagtctcaccgtctctgcaggagtgttcctacctgataatgaggctctcactcctggcatggaatctatcccactcccccgactttctatgagttccagttcagaggttctcaatgattctcaactgagaacactagaacttcttagtacagtggttctcaaatttggtttcacgttttattcatctgggaagttctgtatttttttttaataccggtgcctagccatcacccacataaattctgatttaatcgttctggaataggtttgagtcatcaagagtttgtagaaatttcccaggtggttctaatgtgcagtcagggctgaagaccactatctttgcaggcttcttgcaggcctcaccttcccagtcaatgccaagagccaaaccagtccatccaggggtctacatacacacacacagacacacaccaaacttgctataagtaaatagctcaaggaatgatagcaaatatatggtcttccttattctaagtgaagtaactcaggaatgtaaaaccaaacactgtacgtcctcactcataagtggaagctaagctataaggatgcaaaggcataagaatgatacaatggactctggggactcgggggaaagggtaggagggggctgagggataaaagaatgcaaattggttatagtgtatacttctcaggtgatggatgcatcaaaatgtcagaaatcactactaaagaacttattcatataaccaaacaccacctgttccccaaaaacctatggaaataaaaaagaaataggaattctctaacacccacaaaaaaaaatagatggtcttcccctatatctaagttgttctagttgatccagtctttcttggagggtggtataaaatgaaaggatgggtggtttcaaatttttcagactccgaaaaaaaaatgaatacaggatctgggtgggaaataatattactaagaagagggaagaaggaaaacagctgaaaataaagtcaggttaagtgattgagtccaaggtaaaatgttataacataagaagaaagagaaaagtaagaaggaaataattgagatattttaggaaagttaatgttatttaaatgaacagacttacaaataaggaaactctccatccagttattagcatcatccaatgactgaggcactgtggataatgcaaagtatacaggtcctgagccaaagtggacagatggaatctcatctctacctctttccagctctggaatcttgggcaattgtgggagactttccaagattcccacagcaagatcttttctcacacattatcttcttacaatatgagattgaatctcctcctgttttgaggtaggatctgtccttcccatcccttgagtctaggaggtaagtacaggggtgtgtaagacggtgtgggagctgagaaggaacttgctgacatgtgtttgttggggactgattcagaaaagaggtgatgctcagtctgagtatggaatgctgagatggagtttgccaggcagagaaaaggtatttcaagtaaggataaccaacatatctgaaggcttgaagatacaaatgtgcgttttcattacaccagggcttctgaaactcagctgcatggacatattcttaaaagatttaaagaatttttattattttaaagggttaatattttattcaagtttattgaacagatataattcttcataaccagagacaatacaaggcacataaaatgcacatattttctagagaaacacagagcttctgaattgaaggggacctcgggatcttttatctcagcccccatgtacccatgtgccatggctgagtgatatagtataataagcagaaagactgtgaaaccagacacatagctaaagagcaagtgcaattaaaggttaaaattagattattattccttttgatgcccttcccccatggcatatcacaaaacataaaagcaaaggcaagggaaaaaaacagcaactgggaagactataccctctagccaacctatcacaattataatgtggtatttgaaagaagaaaagacatttcaaaagggcaccattattaatgccaccaagaagggattggaaagttgcagtttaaatcattgattttgtgccagttctcttgtttatataaatatcaattctcactgtgaattattgcacctttatttagttaggaatacatttttaaaatgccttgctaaaaggtgtgattcaatggagagaaagtattatcaagtagtgcaatgatccataaatagctattattattattatttaacattcgttaaacacccacagtgagctaagcactgtaccaaactttgggaggatgtgtttcttactctgacgaggacagattaaatatgcgaaagagaggaaagcttaggatcagggaaatttatttttctactccaacatttccatgtcaaatttccacttgtcaaattaacaaaattcaagatattataatagtattaataatagttatttcttgtgttcagtgttttttacattacgaagtgttttataaacctatctcattatataacttggcatatagtctctggaagatgtgagaataagagaggtaattttatttcaagagaagcatcagctgatttgttggagcatgaaagggcagtcatactgaaggagaggggagagtttttttggataggtagtatatgcaaaaaagaattgttcctctcacctggctttcagctatcagtttccctccctgaaagcagtcactgtaatcatgtttttgcatatcaatcgagataataaatgagtttactaacatacagtttacacatgtggtatcacactatgttcactgttctgcaccctattttctcttacattttggagattatttcatgctacattattatttttaatggttgcatcctattccatatataagtgtaccacaatttatttaactggtctgttattaaagcatatttatagaaattttgtcacaatttttgtttctgaaaaattctgctattacaaacaataattaaataagtagctttgtagaaacacctctgcaagtatatatgtaagataatttcctataagtggaattgctgagccaaagtgtatgtgccttggtaatttggtagttgctgctaaattccctctggaaaatgtatactggctgcaattcctagcagcaatgtatgagtgcctgtttccccacactgtcaccaacacaatgtgttatcaaaatttgagatatttcataatctgatgagtgaatagcagaatctcatggtagtttcatttgcattccttctaagtataagattgcttaagcattagttcatagtttaacaaaaacattagtggttccttttctgtgaactctatttatattttcagttcttttataggtgggtgttcttttttgaattggtttttggcaactcctttaatattgatgaaattagtccttaatacataatctgaattgcaaatatttttcctagtgtggcattcgttttcattaatggtatttttacgttacagagttatctagttttaataacttagtgtattaatcaatcttttgtggcctctaagttttgtttcatgttcataaacatctctattaacacaagattattttttaaaaagaaacttcctagttttcacttatgattttttatgtaaattgttaatacctttggtatttattttattatgaggtagggatctaactttatttttttaatagatgactattaagtggtcccaactctattcatgaataattcaactttcttccatgagtttgaaatacttctgtcatatactaaattcccttgtaggggaagtgctttgtaaatgccatcattattcagtttagaaacgcagacattcccctaggttaattcactagagttgatggttgataataacctactgaatccaagcagatgtgtggggcaagaaacacagaaacagcaatatgcaggaagcaggaggggtgcctagttggaattaagagagcaaataggaacagaggaaaaataagattaaaatgtcagagaaaaagtagggacaactccaaaacaaatactttcatgatataaaaggtaatgagaggacacctactccaactgccctcctgataaagttcaagctgcatcacatgaactccaggacttttctggtctggtctctacctacctctctagcccagcgtagatttctcactaattatctttcaggtttcagcttgaacattattttccgccatgtacttccaagacttggcaaagaatgaatcaagtgttccttttttggtccctgcagcattctgtgcattgtattgtctggtctctttcacctctgttgtggacatttttcttcactcccagcttttagtcatctctgtcagttaccaagtttctctctggatgacttcttctcttacactaagcccacgtgcttctgatggcactgacttgaccccatccctgaggtcccacacgtgacctaggcaaagctgcttgatacgagtcactctccacaccccagccacaccccagtgagtggttcagggattggcatgtgcccaaggagagctaatgtgacacagtggaacttggcctggggagcctgaatgaaaactcaaaccagaagtcatcttacaacaacgggggtctacagagtggaccaaaaatgaagtagaaccaagaaatggagggacagggaaagccatctgaagccctggatcaaactggaaaccaatatcatccctggattatttcattactaataaattccttggttttcttcacattgttttaagctcaattttctgtcacttctagaaaacgactgcaacttcttaacagctcctgaaggttgtttcttaagggaagaaactgtgtcttaatgctattgtattcccagggctccattcctggagcacagcaacattcaataaatatacagggaagaaaaaggaataaataatacgacaaagttcttttaaatcctaaagtaacaactgcttccaggtatggatattctacttatggaagatcactgagttgactgatggcagaatctggattcaaatctaggctgacccgggcccaaatccttggtttgctcacctgtaaaatggcaacgctttgtggtttgatattaaaatggtgatgataccctcttttattgccggaaccaaggagtgtgccaaagagaagaaggttcctgctttgccaaaaaccctcaagaaaaagcaaagaagttttgcagagctgaagatcaagcacctgagaaagaagtttgcccaaaaggtgcttgtaaaggcaaggagaaagcttatctgtgaaaaactgaagcactttcacaagaaatatacacagatggacagaatggagattcgaatggccagaatggcaagaaaagctggcaacctctatatacctgcagaatccaaactggcatttgtcatcaggatcagaagttccaatggtgtgcacacaaaggtgttctgaaaggtattattgcagcttcttcacctttgtcggatcttcagtggaacctttgtgaagctcaacaagccttcagttaacatactgaggcttgtagagccacatattgcatcagggtacccaaacctgaagtcagtaaatgagctaatctacaacagtggttatggcaaagtcaataaattaatcgccttgacagataacactttgctcaatctcttggcaaatatggcatcatctgcttggaggatctgattcatgagatctatactgttggaaaacacttcaaagaagcaaataacttcctgtggccctccaaattatcctctccatgaggaggaatgaagaaaagaccactcattttgtagaaggtggagatgctggcaacagagaagaccagatcaacaggcctattatgggaatgaactaaggtgtctaccatgattatttttataatctaatccattagtaaacagtaactgttttcaaattgaaaaaagtaaaatgataataatataacagcacatatcaaatacttattctctgttagaactgattatttcacaccttttctcctgtagcctcactgttcttcagaaactttatggattataaaaaccatgaactctctaaactctaaaagaaaggcatcatggatatgagcaattactctgatttccgcaaataaaattgtttcatttagcttccaattgcctctgctaatgagagaacgtaaaattgtggataatcaaaagtcattgatatgtgtttggagaccttgttgtatgatgagttcagcagtaaattttccttgctaatttcattttgcctccagtggcaaaaaaaaaaaaaaatgagtttggattgtctgagcatatgttaactgggtgatgaaaaagataattattgtgctggacatgaacagaaatcattttattttttaattttattttattttagattcagaggggatgtgcaggttttgacatgggaatattgcatgatgctgagatttagactctagagattccatcgcccaagtagcgaacacaggtagtcttttggaatccccagtgtctattacttccatctttgtatccatgtatacccaatgtttagctcccacttataagtaagaacatacagtatctggttttctagaaaccatttttaaatgtccttaaaatttacttagtgtaatctacaaggcagataacccacaagcagataattgaggggtgaatgtcaactgaatataagaaaatgtttgttctattgcattattatgattttaaacagagcattataattttttattttgcaataattaaaagcaatcttacctactttagttggtgggattttcattaagtgtaaaattttatatcacttgaatattctcatgtttcaattgccatcttaaaatagcacaaataatggctgaaacattattcattctattcataagttaatgctgcttaaattctgtcagtaaaatgtattaaaaattctttatgcattttttcatcccttacattcttagctatgcaggggttaaaggtcatgcagaatacttcaaggtattgtttgggtattttcaggggaaaaaaaaggttacctaaactgagtgaagtaaccaacttttacaaggctcttctcatctcattacaactggtggttgtacacattgaaatattgttgtatggggcagttttccaagttgtatgaaaagccttgaaatatttagcattttactctattacaatttgagaaattatattaaaaaataaagaaacaaaacgatatatgtcattgcagcactatttattacaggtggaaaaattctaaatttctaataataatggcatatctgtgactttaaaaataatatttcaaagattatttcatagccaaacaagctaattataatataattgtttttaagtcttaaaaaaggcagggaattatcccagatatctgtatgagtgtgtatgcgagttgggggaactctggaagaaaatctgccagtgattactggggttatgccatatagatgatttttacttctcattttcaacctgccaaatcataatgagtttctgtaataaatctgtataacttttatcagaacaaattctgttttcataactagatcctagttcccagagcaggcagattaggtaaacagccctctttacaagatggtttctaaaaagaggcttgaacacagaagcacgttctaccactgctgtttctagttagctagttctttattacagttgtatttcacagcttagtctataatatagaaattctctagcaaggttggatacctccttactatttagtaggaggatttactttcctggggggtaaaaactgtatcttcattctaccctccaccttctccttttaaatccttggcttttaactccactgtaggttctatgctccttgtctggaagctggaagacctattaggaggctgttgcaatagtctgagcaagaaataatgagccagaacaaaggcagtggctgtgtgtgtgtgtgtgtgtgtgtgtgtgtgtgtctgtgtgtgtgtctgtgtgtgtagctgagtgggaaattcagtaagtctgaggctgacagggaacgcaggagaggggatctctccccactgctgtgctgattacagctataccccgctccataaccttgcagccaccaactctcataaaatctaccaatcagacctaaaagagatagagcactgtaaccacaaatgtcctggccatcagcatagagactttccaaaagacccgccccaaatacatatgttctgtagggtcttagctcaccctaacttaacatttgcttcattttaatagtaaaaatcacagcccaggaaggagatttaagatactaatgagacataggacatataaagaagcatgacaagagaccgcacaggtgcagccaacagaccactgcaaacatgcaataatgttacctggaagagagcttagaaagaatacaagttcaagctaacccactttcaggcagccaacagcagatctctttctgctgtagtttccctttctgctccaggtgaaagccgcaataaactgccttgctgaagcccatcttagactctccatcagtttctattttctgagggtagagaaccgactggccagtcacaagtccacacggcccatgtgtattctctgcctagaataagtctccttcacctctggttgaccagatccttctatccttcaagttcccattcaaacatctccttctccacaaaacccttctatacccacagctggaagtaattttccctcctttgatttttatgtttttacctttttcatgtatgtatatatttttttattttgaaacaatcaaaattgcaatacagagaacttttttaaaccacttgagagtaaattgccagcctaatgctccatcacagctgaatacttttgtgtgtatttcctgcaagaaatgagacattctttacataactacagtacaaacttcaaaatcagaaaattaatattgaaatattaatgccatctgttcctcagtccagtaatgttctttatagcaaaagaatcctgttcagaatcaagtgttgcatttaattatcatctctttaatctcattcaatctggaatggggtctcagtcttaaatttcatgaccttgacaatttagaaaatacagactaacagagtactcatcaatttgggttttctagtgtctcctcatgactagatccagtttatgcaccttcagtagaaatatcacagaagtgatgatttgttcttattaaatggtgcatgattgcaatttgttctattattagttatgctcactttgattgcttgattaagatgatttcttccagtcttctcaactttgaagttattcttttcccctgggtaattaatgatattttgtagagatatattttgaaacttttaacttattcattcacttatcttttgtcagtatggactcactgtttattttattctataagctctaatccattactatcattatttatttttaacctgaaattgacaagatttggccagcagaaaccccttcaaagtggttcctgtgtactttgatacatcctcaccattctttgagcatttctttgctttatgttacaagatgttccaagatcattcgcattttctcttcccccaacctggactcatccatagttctacaaggactcctggttccctgaagaatggtatttagaaaccaaggtctgagtcctaggagtttttattgcatttggggtggtactgctccgaagactgctcagtgcacaaaacttaaaatcatgggaatgtatggaagtgcacacatgtataaatccacacgtttacatcaatagttattatctacctgtagatactgaaaatcatgagttcacactcaaaggttccaactccattgagtttattccagctttctccctttccatatatgcaattcctatttccaatagtgaaaaacctggctcccattatccttaacatagttacttacttaaacacttccatatatgtctcccatctttggaactatcaacttctcacataaatatcctccttattccactcaggtcatgattgcacatggacatcctctcctgtatgttcagtctctgaaacccatgttcaagtcactctcccctaccgctccatctatatattctcctaagcctgtgcattccctgaaaattccatgccaggccacccaccccctgtgatatccttgtcaccctgcttgggctctgttacccactttggactatcctatatgtgtaccctcctcactctaccaggatgcccgtacatggacatcctctcactctgattacaaataataaaattttttagttaaagaaaaaagagatactggtaggatttttagtctaggaacatcctaataccttaaggtccttggccaaaccttaatttattagcatacgtgaaacacactcatggaaaagtgattcctttccttcttttctgcctgtgagaccagaccagtcatcaatataatcattgtttaagggaaaaagtgtattagtttttttattaaatctcaccttctctctttctctctctctctctctctgagacacacacacacacacacacacacacacactctctctctctctcccattcctttaccatgaaagcttatttcactgttgctcaatcctctgtggatcaaaatcggcaaaggatactaaaagtactaatatttttcatggaaaacaccgcctattgtattctgttgctggaaagattcttccacaagactgatgacagaaacaaaggaaatacaaggaagaggttatggaaaacaggagggagagggatgagtaaataagaaaaagaaaaggtgggaatgaggaaagtagcaagaagggaaatggaaagaggtgatctgggagagaaaaaccacaggtgggatgctaaatgggagaaatgtgaaaagaaagtagtgggagtggcattcaggagagtctgacttagccaccaaatcccatggcaaagagtgccaactttattatcagccccaaagcagtgctactgtcaaaataaaaaataaagttacctactccaaaatcactgacatgtctaagcaagtaatggagaaactgttggttcatacactttttgagaaccaaacttctgaatttttgtctacatacttgtttcctgacatctttaaagaattgctgtttggagcatcagttttggacaccacacatcaacatctccaagatggtgaaagagttcttggttgaccaaaactttgttgaagaaaaatattgatatgtgtataaatggaacgcctgcactattagcatcacatctgattttgctgcttttataaagaaagaaactacacatttcatcacgtcaatgtgtctgactcaatcccctaccaacgatccagaaaaatgtcttgtctaatgctaggatcttgtcaaatccaggttatgaaatcattgcctttttatcactttgaattcaaaaacatactttaatatgaagttattctcttcgtattcttcattatagacctaagtttgctggatttccaaaaagtagtttttgaaacacaataaaacttaagggaaaattttgctccttttacagaaaaagaatatcacttcttagaacaatttttttaagatgctctattaactacctttattgtgacactttttaatactgtatgaaaacctcggtatggtgccaatttctttttttccctcttaacttttattataggtgtggggtatacatctgcaggtttgttacatgggtatgttacactcagggagtaagcttagtacccaacaggtagtttttcagcccatgcccccttccccctctccctcctctggtagttcacagtgtctgttgttcccacgtttgtgtccgtgggtactcagtgtttagcttccacttataagtgagaacatatggatttggttttatgttcctgcattaatttgcttaggattatggcccccagctccatccatgttgctacaaaggatattatttcattctttttatggttgcatagtattccctgtatatgtaacacattttctttacccaatccacaattgatgggcacctaaggatgattccatgtctttgttattgtgaatagtgaggaaatgaacatatgagtgcatgcatctttttggtatagtgatctattttcctttggttttatacctaataatgggattgctgggtctaatggtagctctaagttctctgagaaatctccaaactgccttccacagtggctgaactaatttacattcccaccaacagtgtgtaagcgttcccttttctccacagcctcaccagcatatgttgttttttgactttttaatataatagccattctgaatgaatggctgaaatggtgtctcagaatggtgagatggtatcatattgtgattatcatttcgatttgcatttctctgatgattagtgatgtggagcatttttccctatgtttgttggctgcttgtatcactccctttaagaagtgtctgttaatatcctttgcccattttttaatggggttatttgttttttgcttcttgatttgcttaaattcctttatcagatgcgtaatttacaaatattttttcccattctgtaggttgactgtttactctgttgatagtgtcttttactcacagaacaatttgatgaagatttattccatgattagtttaattagcagatcttttttgctgaagtaaatcattctatatgcttcctacagatgttattatagatactactgaaaatatcagtagggcacattagttactttcccaacattcatttcactttattccttcctaatgaaatcctgattttagtttgtacattatttcccccactcaccaaatgactgaggaaaacaaatctcattgccaaattgtccctccttagttgaaaccagtcagcacatgacactgttctggctactgttatataggtagaggagaaattacatggcctgcatcggtccaatcatagttaggggaagaactctcttttacaatgttaagaacatacgttacatcagattctcctggtaggtgacttgtaaccataggagaaccagtctgaattccaggctgtctaatggagcagaaatatggaaagcatttatgtcttgataacattatggatcactgagtcaccaccctgaccaaagctgactctacttctggactctctgttatgtgagataataaatttctttactgtataatttgtcattgacttgggcttttgtacttgcagccagaaatatcctaattgatcaaatcaagtccaacctcctgtctgaaaactgaaattgcaagcagacatgcatgccaactttgaggtgctggtgaaagtgtttctgcaggttaggccttcacagcttccctgcagaaagaaatctgaaaacactgaatagttcccatgcaggtttcttctgctcagataattttaaagcttaaacatgacctcataatcctttccttcctggcatagagagaattggtaatgccagctttgcaaggtaacctcattgatttgaagaaaaaggaaatgatgctacacaaattaaacccaagagagtcttggagaattctgatgttctttgacagcaatgtacctttgagtcacgggttttagtaccagctgccatcaaaataaaaatgtcaaaatcaattgagtgtccaagataattttcacattgctatgtcagtctctttttcaagtttaacatcagatggcttaatttgtacagagttaatgtttactcttaggattttattttgatttttttgcacagtttagattcatcttgattatttcctgaaaatcaccactaaatttacatggcttttcccatgaagaaaatattctttgaacaaaatcaacttccagttcaataggagaaaccataatcatatgcaaatttgttatgtatgtgtatatacttttctgaaaaggggaattatattttcatctgattcacaaaggagtccatgactcaaaaactatttctgaaggccaaatagtaactatagatggtcagagaaattaccgtgaaagaggaaaagagaagaaatgaaataagacgtattttttaagttttggcctggttgagaggacagatataaggtgactgcctcttggatatggcaaagtggtggtatatatatttgagtctattacagtatagttggaaaacataacaagtaaataagaagtccctggagactttaagacatgtaatgacaatatattgctgtgtgggtacaaattaggtgcatgcctggatcaatcaaagtacttgtaggaaacttaagacacaatccaaaaaaaaggtaattgaagagattttaatgaaagtactatttacaaaagagtaaaagatgggattaagggaagccacagggatggtgaaagagcctaggattgacaacaggagaagccattaccgcttctatgccgaagctagcctattgagagtcatggtggtagaaggatgcctgacaggagctatgatcataggtggaaggttacagaaacggtccacctgcagcaccacaggaaaggagccccggaaataaataccccattctcactctctccccataatctgaccgcctgccaaagcctctcactgaccaaatccaaacaagagctgagggggtggaagctggattatcttagctgacaagatcagtcctttagaatcaaaacagggtcggccaggcgcggtggctcacgcctgtaatcccagcactttgggaggccgaggcgggcggatcatgaggtcatgagatggagaccatcctggctaacagggtgaaaccctgtctctactaaaaatagaaaaaaatagccgggcatggtggcgggcgcctgtagtcccagctactcgggaggctgaggcaggagaatggtgtgaacccgggaggcggagcttgcagtgagccaagatcgagccactgcactccagcctgggcaacagagcgagactctgtctcaaaaaaaaaaaaaagaaaaaaagagaagaatcaaaacagggtcatggatgaagagggacgtgacaaggcaaacaggcaccacccaactcagacacggcccatataacagtacaggagggactctcaataagaaatagagatatttagttccacagtagctctgatacacatttttggcaaagatgtgtatttcagaatcctttccgtttagttaatgctagtttttagtcatcatactctatgttgacaactttacggatataaacaaatacttattttataatcattaagtttctgatagtaaagctaatttttcccctcaggcaaaaatattcttctagtttcatagctttggcagtactttattcctcttaaagagtaaagtgtttatgtaaactggaaacaattgttttgattccatctccaaattatactaattcctatgagattcacagttcccttttgagttgttatgaacctaaactgtgtccaggagtatgtgtgggtgggtgtgtataatgtactgaactgatcaattgacagtccgtgtgtacatgcacctggaaggccaccactagctcatcatgtctgtgtcttttcagggatggactgcataggttgtctggtgcagtggaaagagttctgaagacactggtcatgatctgtcttttcactaagcagctgtaggtcttttggcaagtccctcacccctccaactactcttcaaaggagtaatgggttgaggcaacagaggctcagatatccaccgactttaagttctgtggttcccatgcctgtgcctgatcagcatagctaatgggaacatccactttgctgcttactgactgctctggtttgaaaagagctttgttttaaacttatctagagtgctaactactctactttaaattaaatattagataaggaaagcaacagatgacattaaaatacaacaaatcctcagtgactttctgtgggtctaagagttacagcctcacatgaaccttaggatttccgtgaattgcataaattatgcttaccatttcgcaggtaaatatttacatgtccaagtaatgactccacaaagctgtgagaaaggaagaagataattcatgccctagaatagatctgtacattgtaattcaggtccactggagaaactctatttactatcatcttcaatgtcctggaatggaggaaggagctatggagccactgctgaggccaaggtattccatgccagctgtcacatgggtatttgtacaacattcttgcatcatacaaataaataattagctacgtatttaatacctactgcacactgtgtattacatatattgtttaattctcataactgtcctttgatattatctccaatttactggtctcaaagaaatcaagtaaattaaccaaagacactacctaggaagggaaagagtcaggatttcaacctaagattctaaagctgatgcctctatccttgttaccctagtgtctccagcaactctggccagacatattcactatctctcaaacacttccattggtttttcacagaaaatgaagctgttcacttaactttgatttctcccttgagtgatgtatctgaacccttagccctccacatgtgcctctagcaatatctactattccctggagaataagaaccaggtgggctgggcctggcctcaattgccagtattctccagctccatagcagggcaagcaacacatccatgtgacctgtctttacgcactagaacttctatctcttgtctttcttctaaattatagaccatattttcctgtaggcatctacctcctcttcccttccaccataattacccaattatctaaacaccctactccctacttcaactgtctctagagaacattcaccttctaaatgtgctttagataattttatacctttactgggctttgagaatttttttaaggggaggcactgccctaacccactctccttttgtcttaggttgggtttcttggaaatagattctaagatggagaattgtgtgcagaattttggttgtgatgtgctctcaggcgatacacctgcaaggaagtgacagaagaatgcctgaggaggagtgagaatccaggaatgggtcagccctgaagaggggtctggggcaggcactgtggtgtgcactgtacctgctcagattggtgggcctgacttgtgtcttcagcttaaattacctattcctcttccagacaaaagatctttaaggtcctaaacaccagtctggaatctgactatgcaaaaatgaaaagatcctgagctccctctccagaggaactaagtgaaacaaagaacgattataaagtaggaaagttctaaaaatagtaagatgagactgggtaatttgaatgaaagccagtcaagtctatgtggaatatagcatcttactgattcattatcagcccatataatttaattacattctacttaccatgcaattttcacatcctaaaccatccagcgtgaagtctatgttatctgattaaagaaagaggaaagggagagaagggagtgagagaaaaagagagctcctgaagccatgcaaaagaggagcttccttaaggatggcagaatgcattgcaaattcagaaacatatttaacatataaaagaaataatgtaaatttatctcttgttttctataaataagccaggtttgattatcttaagctattaatacaaatattcttctctttgtctttcttaacttgagccatttacaatttgtaacacagagaatcatttttcagatctaacttaacatgtaactcttcattgtttcaactgaaattagcaaatcccagaaagaaaattcttccctaagaaatcatttcttcaaagtgattatttaagagttgctaagttagaaacatacatatcactatcactatcttctgatcatggtatcactatcttctgatcaaaatttaaagatattcatttgaagaacatttatacctcaagttctaggaaaaggaggttttagtgactgaaagatgttgaggaaaatgtgaagctcttaattaaaattattgagtcacgtgaatatactgaataaaatggtggttcccagaagctgggacaagtaatgagaaaggggaaatgacgaggggttggttaatgggtacaaaaatacagttagtagaaataacttctagagcttgataccacaatagggtgactatagttaataatttttattgtacgtttcaaaatagctagaagagaagatttggaatgtttccaacacaaagaaattataaatgttgaaggtgatggatatcccaatcacccagatttgatcattatacatcatatgcatgtatcaaaacatcacatgtaccccataaatatgtacaacttattcagatctttttttctatttataactgattgaataaacctattcattttactaaacaattagttttcaaaaataaccaatatataaaactgaagaaagtcaaagaccatatcctgaattacaaaaataatattttaaaatatatatactcctagaattatttgactttcacttaactaatactctttgtgatcaatccccctgattaaattcaaatttatgttaacctatatttacatttatttttggaggtactctagaaaagttttccaaactgcatcctagttgctgtggcctttggtttgatggctttcacttttgagttcaaacctcatttcccaaatacattctacaactaggcatatttatttagaactcaaaaggccaccatcttcagacttaagaaacaaaagcagcagtggtttcattatatttcatatatttcattatattttacctgtgtgtaaaatataatactgtcttcttgggcgaaaggtcatataattctactctcatgtggatgttttccacaaaatgaatacatagatttaaactgatcaatccacattctttcaattgacctctcttaaaaaccaaagcacagccatttgagcttcagtgcttagagcaactctttctggcctgtgtaaggaatttacccatgacttgggttttaatactgtactctaaccagcagcaagagagagccaccaacaagaaaaaacagggatgctgattttaagaacttaattacaagaatttatcagttagaataaccctaagtactgtaacaaataaaccctgaaatgtcagaggcttgacagagcagaaggttatttcttactcagataatggcccaactctggaactcctaattgggaggtagcttttctctacatggtgatttgggaaacagactccttgcctcttgtggtcccacagggtctcataatcttctgcattttgccagtggaagaagaaagcatggagaaacatcctgtttcttaaaaactgtggcccagaggtaacacacatcacttttgctcacatttcattgatgtgaaataatcataaaatcaaactaagatgcaaggtggtgggagggggagtgtgtagaaaatatacttaaacctaaactatgggacaaggagcacaagttttggtctacaactattcatcacaaccacaaacaccatcaagcaagaatttatcaacacctattttattctggatgctgtggtaataatcaaagacagcataggccaagtgacaataaagaactataatgtattcacgctgtcattcagcaaatgcttactaaacatctaccggctggcacttgctgggccgtaaactaaggaaatgaagatggtgctctcaatcccatataggagacaggcctgagcagtgctgggttacctcaaagcaaatcaagtatatttttaggattccaatgtaggagcgccaaaactagagacagaaaaaaaaagaaagtttttgaaacaatttgatccctgatgtgtccttaaatagcattaaaatgttcatcaaaataaaggtaagaactttgtaggatttctttatacttatgattaacattttttaattatgtgtatagggaacatcaaaatatttttataatatcctagccctttaaggtatcaacttggtccagatatttaattaagtgtaaggaatgtcccaaaagacctcacaaatgggatggaatttgagtgccttagaaaaaaaagcaaggctcagataagcagaagatatgagggaaggtgttccaaatcaaaggaactaggatagcgctagtcagcagagacagcatcaggacaaccactatggctgtgaaagataaattaactgggtgatgggtcctcttaacagcccagcttcactcagatctgccttccctgttgaatgtgagcacctcaagggcaaggaccatggccatcctttagccccaattaccagtatctacccaggtttggagaactgaataaaattcaatgtgtgcatcaacttgcttcttttaaatgctgcaggatacattgcaacaaggtgaaatttttaaagcatatcttgactctggaaaccatatgttgtcaggtcaagatgggaggcatgcagtgctcttatctgtctcatatttgaatgcttctgacttttatcacagattaaatttactggaattcatttatttctatacatttctccttctgtcatcccctcttactttgtgtagtaaatatgagatatttttctccacagactcttcacctcagaaaactgtcattatctattctgtcagtcctaaacatctggagaattggcaaaactattagttcaaaatttatgatggcattcttcacattttacagaacaaattctggtaatgtttactatttccaatatctggaggactgttatttactatatatgctttttttcacaggagaaaagtttatatcactaccttgctatgcttcttagaaacatttttaaagtattatatagggtcacaattctatcagtgtttttgtaagagcttgaattcatactcatggtgtttgaaagaatttgtttttctctaggcagagctaagattgaaattagatttcacgaagatgacagttttcaagacatttgaaggcagtctttttaaattctaggaaaataaaatatcttagttctgacattcagatatcaatgtaggctagttgctagtgagtgagcactaatcagtcgtaactttcttctgctgaatctgaacaccacctccaaatactcagcccagcactccatcagtaagcacccatgagttgaagtttatatgaggtgagactattcgcatttcccattatatctgaagtacctcacttgtagcagttaagaaaaataaatataatcctataatatttacagagatattagtaccctatcaaattctgcttagtgctactaatccccatagaccctttcaacactttgttaagaaatagtgaaatttgattaaccctattctagaagggattgtagttaatgagagcttagcaactaagaaagttcacggggggtaagaagaaacatagcaaagtccccttggcctctttcataaccatactattgaggaaggaaaaagaaaaggaggcaaaaattgacaaagtaaatattggaaacttggaagtcagaaaatatgtttatacaaagggaaagcaaaacacatttactgttgaggcaagacaaccaaatacaaagtaaataaacacatatagaacaaatatggcaaatatatagaatgcatgctccccaacccctttccacagccatggcaaataccaattatcaattcacagcaattctcatgctgagcccatgtgcaatcttagcccaacacagtgtcagtataatcactgaaacatgagatgagataaggcttagttgtcattcccagtcttgcatctgttgctaaagctttcttaggttttttactatactgtatataaaaagctagggctctccaaggcacacaagtcttaaaacttgccacaagttagcagtgaggcagataagctgatctcatccaacctcccttcaatagcaaaggaaaaagaaaactaacttatatttctctaatgctccgtaatgtataaggagctttatcagcactacccaacagaattttgagcaataatagaaacatatatatatatatatgttcaatccaatatggcagccactaatcacatgtgcctattgagcatttgaaaattagcactagtataactgaggaactgatttttactataattaagtttaactggccatgtgtcttagtcattttgtgctgctacaacaaaatagcaagatgggtaatttataaagaacagaaatttattttctcatagttctggagcctgagaattccaaaatcaagacattagcaggtttggttgtctggtgagagctacatcctccacagggtaagaatacagtgtcctcacatggcagaaggcagagaggcaagctcaccaaatgtgtgaaaccttttataagggtcttaatctcattcatgaaggaggagccttcacggccctatcacctcttaaaggctccaccttttagtactaacacattggcaacacctgactttcggagaggacatagttaaaccatagcactatatatggctgctatattgaatagcacaggtatccatattatctaatttgatcttcacaataactttgtcaagtaggtcatctccattaaaaagagaaggtaaagagacacagaaatattgacttgccaacattacaaagctagagagtgaccaaatgtatacttgaatctcattctttcagaatctaagttatcagacccttctttggtaccacatcaaacttgaggtaggtatggatcaaaagaggaccatgccctgaaactagtggttctatgcagcccactatgagtttaccacgggaagtacactgcaaagaactaactctgaaaatctgagattttaccctatttgtaagctaacaaattagcatgccaatttcatgaaagccagcagaacacagaagactcctggatcagagtaaaaggactttattactcacagtaatagcagtagacagggtatgaacattttcttacagcaacttcccaagcccgaattcccacagaatgatggatgcagagggccggatgactcttgtgcatgcagtgggttgcattacagtttgcaaacttaccttagaaaacctaaatcatttatagtaggcagaaagcatgcctactccttattccaaagcggagtattatctttatcataataaacagtaagcatgactccctttctctatatctatcctccaaggatgctgtctatacaagcatccttgaaatgataacctgaaatgaaggaagtcccaaaacatgcataaatgtgagaaaccacacaccacttcttctcctgtttggtgaaaaactattttctcctgttttgtcaccaaagagtagaaaataagccaagaaaagagaaagatgactaaatatcaacataagagccaagttgaggtgtaagtgtgtatgtttgatagaaagactacgtgttcaaagttaaaaccaggaattaatgttaagccaggaaattaaagtgaaagtaaatttgggaaataatagtgccatataagtgtgatgaatcactgacatttttattgggcattaacaacacgtttttaaatataatttcccccaaactagaggctacttctttcttggaactgaatgataaatacatgcacataccccttacccaaggcagccatctgttctaagggatcctccaggttactgtccctaccccgacaccacactgcctcccagatgtccttctccctgaagccagccccagatcttctctccccaagcagctctcctttttgcctgtcttcctgagtaccggtccccaaatcaccaaattctaccttgaacatattgaatgaaagtgtgcagtgccttatgccctgatgagaagtggtcttggaagatgttttctgcaccaacttaagaagctatcacaaaatcatgataaaaaaaatgatgagctatttatactttgcagacataggtggttgttggaagaaaagagtgccttaggaatcaaataactggtattggaggattcctgtgactttgtaaaattcaattaaatatccaggggaaaataatagacaacattgtcacctgaggatacattattggtccttgttgaaaaagcagtagtttctaaccagttccttcctaacctatttgccattaatttctggaagttacaaactgtaataacaattaccataacactgactgtagcataaaaaccataggatgttagccccaaaagatggtcagaaataatgaggtgctaattttacagatagggaaacagagacctgaagcaaggagtgtctttttcagagtcacacaaccaatcattaatgtatctaagacacatttgcaggaggattctgttcttcactcctccatttttatacaacatactatctcttgcttttcaacctacagtaagttgagccaaaaaaaaaagatacctacaaatctccttcttgaacatgccctttgaggtggctggaacagtatcaagtggtctgagatagcaatgcactaggtggaagcttagatagatggcactaagtggaagcctagtaggaaacctcagccctgcaggcagcttccatgtgtattcccttgggtctgccacaaaagcatgttgcactacaaaagattcaaaaggcaaatgtgtgcacagcacaggagggagcccagttcttctctgaggagtttcctacttcagtggtgttattaagctgggtcaaaagaaagtcatttcatttttttaaaatatgctaatacaacctcaagcaccagctagcttaaatgataggcatttcataaagttcatttttattattctcagctgaaaagtaaataacaccctacaggtgtccttcatataaaaatgatgtatttgccttcaatggagactctgtattgactaaaaccttatctgtatttcacaagacagatcatttttccccatcacctttcaaagaggtgttgttgccagtctatacaggacaaacgaaaacagtctaataaaagaaatggttcagcaggaactaactgaaagagttcccagtgaccaaaactggaacaacttgagcaataaaataaataacctagtattggattataacccaaagaataaaataaatagccatgagttcatacttatataaataaacataaataggcatcaatagtgtatttataaaataatttccccagaactaaaggctactgcccccttgggactgaatcataaatatatgcacagtaaatatcaatataaataaatgactgaacaaataaagtaggggagaagagataaatcttcctttcagaattccatataatgtatgttcatattctccctctccaaaaggcagagcttaattcctcagttttggaggtagactagacttagtgattcacttcttaaaaaatagagcagggaaagggaaaaatagtaactttatagtggagaatcatggcaaatgctaccttaaccaaatgatgacagttaacaccaccagtaatgtcaagtgaatatcatgttctctaatatgatctaatgagaagggcttgacttctgagatactcttcaccaaaacttataaccccagtctaaacatgagggaaaacatcagataaactgagatcagggggacatttttttctacagaatacctggccagtattccttaagacagtcagtcatgagaaacaagcaaagattagaaagtcacagaccagaagagactggggagataagaaaaattaaatacaatgtggtgtcctgaattggaacagaaagaagacattaatgcaaaaactattaaatccaaataaaatctgaagtttagttaatagtaacgagccaatgtctttttcttaattttgaaaaatgtaccatggtaatacaagaagttaacaatgggtaaaactgaatgaggggtatatatgaactctctgtactttctttacagctcttctataaatataaatttctaccaaaataaaaagtttatttcttaaaatagatggtgcaaatgtatcttattgcatgctcttccctggagcatggtagagttttatagtgaatgcattgccaaatccaaggaagacagaagacttgagaaaactaaatactttcagcagccaggggtggagtggtgacaacaagctgtagaataaaaggaaaagtgatgtttgttcagtgaagaacaaactaagtcttatttgtgtagtggtctcagaagcagaatatgttctaaacaaagagttaaggaaggtaaaagctcaaaccaacaagtaaaccagatttcacagaaacacaaatgtgtagcggctgtccaataatgattatgtttaatagtagaatagactccagttgcaaacatatgttttatacaaactcttcaaattggagacatttctctaaattttccttgtaaattgtgcaggatattacatctgactttcatattatcatctcaaaagtggtgaaaccattttgccaatcacttgcatcacctttctgccaccctgccttctaaattacttccttttcccactcaggccatcctctactttcaattccaaaggtttcagttcctacccaaactgtccccctctacccatcccacttacaacccttagtctcattagaaaaatctcaaccacccgcttgcctttaacacctttttctggatttgccttctaaacaataatcccttcgaaatgactttgtgaatgaatgcaactgatttaaagggtaaagagaaatgtatctgctttctacaaaagctttatgtagatagggaaaattacttgtataacttgccctttttctcctcatctttctatagaaacatagagttgtgtttccaaaaattccaaggaaggcctgggcatagcttgtaatacatgtggtatggaggttattaaaaacagtttttcaattcaagttctcaagcctactatgaatgtttaccaaagaacgacgtgaactggactgacaaatgcattatactttggtcaatatatattaggttcacattttgttttatcaccttgatggctgaagaataaatttaaaagggatggactaaacattcaaagacgcaaacacgagtaaatacttcagagttcaatatgtagataacaaatccatcagcatataaacatgttcagcaaacaacagactgaacaaatgtttattgagtatctcttaggtgtcaggaaatgtgcaagcactttggcaaatgctgtcccatttaattctctctataaatgtgtaaggtaggtataattatcctcatttttcaaattgtaaaaccaagcttccaaagattaagtaacttacccaaggagaattgatgtgttacttaagtaatattagttccaaaatatcagtggcttaacacaataaaatattgaaatgtttctcactcatatcaccattcaatgcaagtcagtggtgggtgtggctaagaatattctatcccactcgtccattcagggacccaaaatactttcatcccatgtctctgccctcccctaggtccccagagacctctccatccaatagctagatggagattaagagcacattaaaggtttttttgtgcaagacctggaagtagcacataccacttatgctcaaagttcattctccaaaagaagaaccagaaaaggaacagccaagcaagaagaaaactttcagacaatgggtaaaactgggtgacagtatataagaactctctgtactatctttacacttttctataaatataaaattttaccaaaataaaaagtttatttaaaaaaaaaaagatggtataaatgtatctcattgcaagctcctgcctggagaatggtggggttttataaccaatgcattgtgaaatccaaggaggacagttaaagaaaccttgggaaaactaaatgccttcagcagccaggtgtggagtggtgacaacaggctgcagaatgagaggaaaaacgatgtttgctcttcacagagcaagtgaactattattcgtgtaggagtctgagaagcagaatatgttctaaattttactaactgtagccactatatttctaccaagcactacccaaaaaaaaaaaaaaagtgactctatctcctcccctgccagaaaaggccaaatttgctttccttctaccactgcatggcagcaatcatccagcactcctcttctctccctggagcaacgtcagaggaagactgctacaacagaagattcaaagaagatccagagtctcataatataatacccaaaatgtccaggttgtaataaaaagtcagtcatcatatcaaagaccaggaaaatttaacttaaatgagaaaaaaaaaatctgcagacgaaaaggatttttgaagcccatagcaaaaacatctcagtgaagaattatgagcacacttgaaacaaataaaataacagaaaatcttgtcaaagaaatagaagacataaagaagaaccaagttgacattttacaatggaaaaaaatacaataactgaaattaaagagctcagtttatggactcaagagcagcatggaaaacagaggaaaagatcggtgaacttaaagatagaaaaatggaaattacctaatctaatgacagaaataaaataaacagaagaaaatcaacagagtattggggacttgtgagatgtaacagaagatctaacatccatgtcagtggagtctcataagggagaaagaagacggggctgaaaaagtattttttaaaataatggctaaaaatgtcccattttggcaaaagatagagaaaaagattcaaagagttgagcaaaccacaaatataataagtcaaaaaaatcacaccagacatatcgcagttaaatttctgaaaattaaagacaaacaaaaaatcttgcagctgtgaaagagaaatgacaccatacctatcaggagaaaaaaaaattgaatgacaaggtttttcagcagaaaccatggagaccagaaaatcctggcacaacatttttcaagtgctcacagaaaagaactgtcaacccagaattctacatgcaaagaaaatatccttcactaatgaaggattcaatacagtcttaggtgaagggaaactaagggaatttgcctgaagatctacactaaaagaatagctaaagaaagttctctagacagaaatgataaggagaaatcttagaccatcaggaaaaaaggaaaaaaacagaaagagtgaaaatatgaatcaatgaaatatgctttcattttcctcttgttttctaaattatgtttgatagttaaagcaaaattgtaacagtctgatgtggttctcagtggatgtagaggaaatatttaagataattttattataaatggaaagagggtaaaattatataaaggaagtaaggtttctatactgcacttgaactggaaactggtaacaccaacagatgggataagttgtgtatatatcatataatatctagagcaactactaaaagagctctacaaagaggtaaatccaaaaacactaaaagtaaattatgatgaattccctttaaaatgtccccaagtaacccacaggagctgagagaaataaacagaaaaacataaacagtgaaaacaaatgaaaaccaaaaaataaaatggcatacttaaggattaacatatcaataattacattgaattttaaaaggtctacataccgacccggagccgtggctcacacctataatcccagcactttgggaggccgaggcaggaggatcacttgagctcaagactttgagaccagtctgggcaacatagcaagacctcatctctataatataataaataaataaataaataaataaataaataaaggtctacatacgaatgaaagacaaagattggaagagtggattaagagaacatgacccggccagacacagtggctcaagcctgtaatcccagcactttgggaggtcgaggtgggcggatcacctgaggtcaggagttcaagaccagcctggccaatatggtgaaaccccatctttactaaaaatacaaaaattagccaggcgtggtgacaggcacctgtaatcccagctactcggaaggctgaggcagaagaaacgcttgaacctgggaggcggaggttgcagtgagccaagatcacaccactgcactccagcctgggtgacagagtgagactccatctcaaaaaaaaaaaaaaaaaaaaaagaaaaaaaaaaaaaaaagaaaacatgacccaactatatgctgtctgcaaaaaactctaaatgtaactaggtaggttgaaagtaaaagagtagaaaaagatatgccatgaaaagattaatcaaaggcagtaggagtgtctatattaatatcagataaaatggacttcagagtaaagaaaattaccacagaaagagaatgacattacataatgataaaaagctcactccaccaagaagacatagcaattctaaatgttcataaacaaaatagcacctgcaaaatacgtgaagcaaaatttaacagaactgcaaagagaaactggcaaatccacaactagaactggagacttccataccccactcaaaaactgacagaacaaaatgacagaaaatcaaaaggagtataaaggaaaccaaaaataccatcaaccaacaagatctaatcaatatttataaaacacttcaaacaacagcagaataatcattcttttcaaggccccatgataaaccttatcttggaccataaaatagacctcagaaaactcaaaagaactaaattaacacaaagtatgtcctctgaccacaatggaacccaactagaaatcaacaacagaagtataacaggaaaatctctaaacagaaactaaacaacacacttctaaataattaatatgccaaagaagcaactcaggagaaatctttaaatactttaaatttttatagagaaaatcaatgaaaggttgtttttctttaaaagatcaataaaattgacaaaccttataactgacatagaaaaataaaagattgttattttgttatcaaattattgatatcagtaatatcagtaaaatgttatcaaattattggtatcagtaatgaatcagggaatatcattacaggcctgcaaatatgaaagagataagagaatactaaggacaattctgtacatgtaaatataacaacttaaatgaaattgatcaatacctcaaaaagcgtgaactattacaattcacccaaacagtttaaataggcctataactactaagaaaattgtattaataatcttaaaactcctgaaaaagtaatctccaggcctagattgtttctctagagaattctatcaaaagattaaagaattaacaccagttacacaatctcttgcagaaaatagaaaaggaacactttccaactcattttatgaagccggtataccaagcaaaggcagtaaaaaaaaagttagagatcaatatcttccatgaatatagacattcaagtccttaacaaaatattatcaaaagaattcagcaatatataaaaagaattatacagcacaaacaagcgagatttattctagaaatgcaaggctgtataatccaccagattaacaagctatagaagaaaaatcacatgatgatatcaatcaacacagaaaaattatttgacaaattttaacattcattcattataaaaaagattcacataaaagtagtagtagaggaatacttccttaacttgataaagaacattgacatgaaacctaaagttaacatgattcttaatagagaataactaaatgctttctctctaagatagggaataagataaaaatgtctgctcttactactaatattcaacatagtactggtagatctaaccgctaaaataagacgagaataaaaaagagaagacatacatatgagaaagaagaaataaaaatgttcatatttcaaatgacataatcatttatgaagaaaatttcaaataatctacaaaaaaactcatatctaataagttagttcagcaaggtagcataatacaagatcaatacccaaaataaaagatatttttatatcctaaaaatatatatgtgaaaaccgaaatttcaaacacaatgccatttgcaattattctaaaataaaataaaatacttaggtgtaaatctaacataacatatgcaggacttgtatgctaaaaattacaaaatgctaatgaaatgaatcaaaaaaggcttggacaaatagaaaataagttaaaagatggtagacttaaaccaaagcataccaataattacactaagtgtaaataatgtaaacatcccaattaacaagcagaggatgtcagactggataaaaatgcgagattcaattacaggctatctataagaaacctacttaatataaagatataaataggttagaaataaaaggattaaaaaaggcatgtcatgcaaacattaatcaaaagaaagttggaatggctatattaatattatacaaactaaacatcagaacagagaatattatcagggataaatggagatttacataatgttataagaactattcatcaaaaaaaatcttaaatgtgtatgtatatatctaatgacagaacttcaaaatacatgactcaaaaattgacagaactaaagggagaaattgacatacccacaattatagttggagattttaacacaatttcctcaataattgacagaacaagctgacaaaacactgatagatgtatataagatttgaacaaaactatcaagcaaattatcttatagaacattgtgtggaacaatcacagaatacacattattttgaaacataagcataatatcaccaagatagactacaagctgagccataaaataagtctcagcaaacttcaaaagattaaaatcatgcagaatatattctatgagcctgagtacaatagaactaaaaataagttttgaaagaatctataaaatctctaaaaattttaagttaataaatgccctcctaaatattgtgtaagtcaaataaggaatcatgaaattagaaaacatttcttactaacaacgaaaatacaacatactgaaatttgtaggatatagctaaaataacgcttagagcaaatggataattctaggtgcttatattgttactgacaaaatgttttaaactaattatcttagcttttacattaagagaccaggaaaagggtggtgaattaaaccaaagtaagtaaaaggaaggaaataataaatataaagactgaaaggaataaaataataggtaataatagaagaaattaagtcattcgaaagctggttctttaaaaagatcaataaaattgaaaaattattacttagactgatcaagaaaaaagaggaaaaaactgaaattaccaagattaagaatgaaagaaggaatattactatagatagtataggctaaaaggatatgaaaggaatattgttttgggggggttgtttttttgttttgttttcacttatttgtttattttcaaacagagtctcgccctgtcacccaggcgggagtgcagtagcgtgatctcagctcactacaacctctgcctcttgggttcaaacgattctcatacctcagcctcccgagtagctgggattacaggaacaggcaacaacgccaggctaattttttttatttttaagtagaaacggggattcgccatgttagtcagtctagtctccaattcctggcttcaagtgatctgcccacctcggcctcccaaagtgctggtattacaggcatgagccaccatgccgggccagttttggggtttttttgttttgtttttcaaaaataggttttaagatataccaaataaactatacagatatcctctaacaatacaaaaaaattaaaaatgaggttaaagtatatagcaaaagccaaatatgacaatacacatgaataatttataaaacaaggcttttaatcctaaataactaaaatggggagacctcactgagggctaacatacataaaatgaggactaatagcaaggaacaatcctaaacattttcccatgtgactgactaagccacaaaaagcaccttagaaaaactattagagtaatttttttctactcagttaccaccatcttttccttttcaccttttccctgattttctctaccaatggtttttctttggtttgatcagttgaacccaaaagatttggaacctaaaatgagtatcaactcttattggaatagcgcttgggaaatgcaatcctagaaaaggcaaatttttacctgaggtagcttgagaaagttcagcatccattctcagtgtgagagcatctcccatgttaatcactaggttaatagctgtgcttggctagattacatgaccctgcatgatactggagtgctccctggtgaggtgctactatctacacaaacacctgcccattaagccttcaataaatacaaagcaccattttaaaccatttcactagaataaatttttaaaatatatcatttcttctggcctaacttgcttcttcagatgggctggggtgctgctcatgacacggaagacataacagctaatgtgtggctatttcaagctctttagacttcagcacttcccacttatcaagcctcagtacttttttgcagcaataatggtattttccattaacattccctctgtcatgggaccaacacccccagtaacaggaatgatgtaactggcttttttcctgactccttaaaattccacatctccaaccaacttgagtttgccagttatgggaccttgacctctcttttttcccagatcaatgactgctgaaaaaggggtcaattcagctagaagataaaacaattgtaatataaaattatttttaaaaagaacttccaaaacctagagtaataaatcaatattcaagtacaagaagacgattaaacaccaagcaggtttaacccaaataagaccacctcaaaacatttaataatcaaactcccaaaggataaagatttttgaaaggactctaaaagcaggaagagaaaagaaacaacaaacaatggagctccaatatctccagcagcagacttttcagtggaaaccttagaggccaggagagagtggcatgacatatgtaaaatgctgaaagaaaataacttttatcctaaaatagtatatctagcaaaaatatccttcaaacatgaaagagaaataaagactttctcagacaaacaatagctgagggatttcatcaacaccagacctgtcctgcaagaaatgcaaaggaagttcttcaatctgaaagggggacattaatgagcaataataaatcatctgaatgtacaaaatgcactggaaatagtacacaaacaaacacaatattataaccctataattgtggtgtgtaaactattcatatcttgagtagaaagattaagagataatctatcagaaataataactacaacaactttgcaaaacagacagttaataagctatgaatagaaacaacaaaaagtttaaaagtagggggataaagctaacgtgtagcatttttattagttttctctttgcttattagtttattatttatgaaattagtctgttttaagttatcatcagcttaaaataatgggctgtaagggattatttgccagcctcatggtaaccaaaaatcaaaaaatatataacaaagacacaaaaaagaaaacacataaaattaaaacataccacctgaggaaatcacgtttgccaaaaggaagacagaaagaaaagaaggaaggaaaagaagaccagaaagcaacccaaaacaaatcaaaaaatggcaagagtaagtccttacttacggatagtaacactaaatgtaaatggactaaactctctactcaaaagacatagagtaggtgaacggatttaaaaaacaagacccaacaatctggtgcctacaagaaacacactttgttactgaaacaccagggcttctgtctaggtcctgctgcttgccacagagaaagtcaatcactgagaccatgagtattgccaaggaagaagattttaattgggtgctgcagccaaggagatgagagctcagtctcaaatccatctctctgactgactgaaactaggggtttatatagcaaggaagaaatgtaacaatgtgtaagaaagcaagaattagagaggggcaaggaagcaatcatgacaaatgaagcatctggcatcttattgtctggatgtagtgatctggtgagtttcagttctttaatactttttgtgagaggcctgaaggtcatttcctgaggaaggaactcagacaaaaataaatacaagtttcaagctttaagaccagaaggatcaatttttatgtctatcaaaaaagaactatctatgagactattgggtcagtttcaacttcatctataaggatgcatacacactgacaataaagggatggaaaaagatattcaatgccaatggaaaccaaaaaagatgaggagtcactatagttatatcagacaaaatagatttcaaaacagaaactataagaagagacaaagaaggtcattatataatgattaaaggggtcaattcagcaagaggatataacaattgtaaatatatatgcacccaacactggagtgtgttcggaatttattccttccggtaggttcttggtctccctgacttcaggaatgaagccatggaccttcacagtgagtgttacagttcttaaagatggtgtgtccggagtttgttacttcagatgttcagatgtgtctggagtttcttacttctggtgggttcgtggtcttgctgacttcaggagcgaagccatggacttggtggcgagtgttacagctcttaatggtggtgtggacccaaagagtgagcaacagcaagatttattgtgaagagcaaaagaacaaagtgtccacagtatggaaggggacccgaggaggttgccactgctggctcgggtggccagcttttattcccttatttgtccgcacccacatcctgctgactggtacattttacagagtgctgattggtccattttacagggtgctgattggtgtgtttacaatcctttagctagacacatagtgctgactggtgcatttttacagagtgctgatagtgctaattggtgtgtttacaatcctttagctagacacagagtgctgatcggtgcatttttacagagtgctgattggtgtgtttacaatcctttagctagacacagagtgctgattggtgggtttataatcctctagctaggcagaaaagttctccaagtacccacctgacccagaagcccagctggcttcacctctcaggagcacacagatatataaaacaaatattattacagctaaggagagagatagacctcaatacagtaatagctggagacttcaacaccccactttcagcattggacagatcatccagacagaaaatcaacaaagaaacatcagatttaatctgcactatagaccaaatggacctaatagatatttacagcacatttcctccaatggctgcagaatacgtattcttctcttcagcacatggatcattctcaaggatagaccatatgttagacaacaaaaaagccttaaaacattcaaaaaaattgaaatgatatcaaatatcttctctggctaaaatggaataaaaccacaaatcaataacaaaaggaattctaaagaccatacaaacacatggaaattaaacatgtttctgaatgaccagtgggccaatgaagggcctaagaaggaaattgaggccaggcacagtggctcaagcctgtaattctagcactttgggaggccaaggctggtggatcacctgaggtcaggagttcaagaccagactggccaacatggcaaaaccccatctctacttaaaaataaaaaaattagctggccatggtagcatgcacctgtagccccagctacttgagaggctaaggcaggagaattgcttgaacctgggatgcagaggttgcagtgagctgagactgcgccattgcactccagcctgggcaacagagagagactccatctcaaaaaaaaaaaaagaaaaaagaaagaaattgaaaagtttcttgaacaaatgaaaatagaaacacaacatatcaaaacctgtgggatacagcaaaaggttacaggaataagtgcctacaagaaaaaagtagaaaaacctcaaataaacaacctaataatatgtcttatacaactagaaaagcaaaagcaaaccaaactcaaaattattaggaaaaaaaggaaataataaagatcagagcagaaataagtgaaattgaaacaaaaaatacaaaaaaacaaagaaacaaacagttggttttttaaaaagattaacaaaatagacaaactattagtcaaactaagaaaagggagagaagatccaaataacatcagagatgaaaaaggagacattacaactgatgtcagagaaattcaaaagatcgttagaggctactgtgtgcaattatatgccaataaactggaaaacctagaagaaattgataaatccctaaccacatacaacctaccaagattgaaccaagcataaatccaaaacctgatcagactaataacaagtaatgagataaaacctgtaataaaaattctcccagcaaaggaaaatccaggatgtgatgacttcactgctcgattttaccaaacatttaaagaagaactaataccaattctagttaaactataccaaaatatagaggaggaggaaatacttccacatttattctgtgaagccagtattaccccccagacaaagatatcaaaaatagaagactacagaccaatatccctaatgaacattgatggaaaagtcctcagcaaaatactagcaagccacattcaagaacacaataaagattactcatcatgactaagtgggatttatccctgggatgctagaatggctcaacattatgcaaatcaatgaatagggtacattatgtcaacagaataaaggacaaaaaccatatggtcacttcagttgatgctgaaaagcacttgataaaattcaacatcccttcatgattgataaccctaaaaaaaatgggtatagaagtacatacctcaacacaataaaagccacatgacagacccacagctagtatcataatgagtggggaaaaactgaaagtctttcctctaagatcttgaacccaacaaggatacccactttcaccaatgttatttaacatagtgctggaagtcctagctagagcaatcagacaaaagaaagaaagaaagggcactcaaatcagaaaagaagtcacattatccttgtttatagataatatgatcttatatttggaataacctgaatactgcaccaaaaaactattagaactgatacacaaatacaatcaagtcaaggatacaaaatcaacaaataaaaatcagtagcatttctatatgccatcagtgaacaatcagaaaaagacattaagaaagtaattctattaacaattgctacaaataaaataaaatacctaggaataaacttaaccaaagaaataaaagatctctacagtgaaaactataaaacatgatgcaagacattgaagaggacacaaaaaagtgaaaagatattccatgtttatggattggaagaataaatattgttaaaatatccatactacacaaagcaatctatggctataaggcaatccctatcaaaataccaatgacattgtgcacagaaatggaaaaaataatcttaaaatttacatggaaccacaaaagacctagagtagtcaaagccattctgagcaataagaacaaaactggacgaataacattacttgatttcaagttatattacagaactatagtaaccaaaacagcatggtgctggcataaaaacagacacatagaccaatgaaacaaaatagaaaacccagaaataaatccgtacgtctaccatgaacttatttttgacaaaagtgctgagaacatacatgaggaaagaacaatatcttcaataaatgctgccgggagaactggcagcattccatatgcagaagaatgaaatagacccctatgtatcaccatatacaaaagtcaaatgaaagtggattaaagacttaaatctaagacctcaaactatgaaactacaacaagaaaacattggggaaactctccaagacattagtctggacaaagatttcttgagaaatactccacaagcacaggcaaccaaaagtgaacaaattggatcttgtcacattaaaaagcttcttcacagcaaaggaaacaatcaacaaagtgaagagataacccacagaatgggtgaaaatatttgcaaactactcatctgacaatagaataataaccagaatatataaggagctcaaacaactctattggaaaaaaatctaataatctgattttaaaacaggcaaaagatttgaatacacatttctcaaaagaagacataaaaatggtatatgaaaaggtcttcaatatcactgatcatcagataagtgcaaatcaaaactacaatgagatatcatcttacccaagttaaaatggcatttatccaaaagataggcaataacaaatgctggtgaagaattggagaaaatggaatccttgtacactgttggtgggaatgtaagttagtacaaccactatggagaacagtttggaggttcctcagaaaactgaaaatagaactattatatgattcagcaatccctctgctaagtatatactcaaaggaaagaaaatcaatatattgaagagacatctgcactcccatgtttattgcagcacaattatagctaagatttggaagcaacctaagtgttcatcaacaaatgaattgataaggaaaatgtggtagcaaagagataccatctcacaccagtcagaacagtgattattaaaaagtcaagaaacaacagatgctggcgaggatgtggagaaataggaatgcttttacactgttagtgggaatgtaaattactttaacattgtggaatatggtgtggcaattcctcaaagatcgagaagcagaaataccatttgacccagcaatcccattactgggtatatacccaaagcaatctaaattatcctattataaagatacatgcatgtgtatgttcactgcagcactattcacaacagcaaaaacatgaaatcaacccaaatccccatcaatgatacactggtaaagaaaacgtggtacatataaccatggaatactatgcagccataaaaaaggaatgagatcatgtcctttgcagggacatggatggagctggaagccattatcctcagcaaatgaacccaggaacagaaaaccaaacaccacatgctctcacttataagtggtagctgaacaatagaacacatggacacagggagagtaacaacacacactggggcctgcggggggagtggaaggaggcaggaagagcattagaaaaaaatagctaatgcttgcggagcttaataactaggtgatggcttgataggtgcagcaaatcaccatggcacacgtttacctatgtaacaaacctgcacatcctgcacatgtaccctggaacttaaaataaaaataaaaattaaaagaaaatgtagtgcatatgtacaatcaagtactgttcaaccataaaaaagaatgagatcctgtcattttcaacaacatgaatggaactggagatcattatgttaagtgaaataagccaggcacaggaagacaaacttcacacagtctcacttatttgtaggagctaaaatttaaaacaatgaattcatggaggtagagagtagaatgatggctaccagaggctgggaagggtagttgcagggggtggagagaatggggatggttaatgggtacaaaagtatagttagatagaaaaaataagatattgcatttgatatcacaacagggtgactatagtcaacaataatttattctaaattttaaaataacagagtacaattggactttttgtaacacaaagaaagaataaatgctgaggtattaaatactccattaccttgatgtgatgattacttgttgtatgcctgtatcaaaatatctcatataccccctaaatatatgcatctactatgtacccacaaaaaatttaaaatttttaaaaattaaactcttctggctgggcatggtggctcacacttgttatcccagcactgtgggaggccgaggtggtggatcacttgagctcaagagttcaaaaccagcctgggcaacacggtgaaaccctgtctctataataaatacaaaaattagccaaaggggtggcacatgtctgtggtcccagctgctcaaaaggctgaggcagaaggatcgcttgacactggaaggcggaggttgcagtgagccaagatcatgccactacactccagcctgtgtgaaagagtgagattctgtctcaaaaaaaaaattaaactcttctacttgtcaaaaagcaacattaaaaaatacaaaggcaaaccacagaatggaagaaatgttcacaaaacattgtgacaacaaaagacttgtatccagagtatataaacatctcctaaaactctatgcactgttttgagattataaaatggtaatgttttcttgttattatgaatataataaccttgtaataatcacatgtcatattccaatcacaatttaaataaataaaaaaagaaaaagagaataaagaatcccacgctgcagtatctcctctacatcctcccactgcttctactgaagatctaattgggaaacagagtatccacccttccttttccctggagaggcaaagaaaagtattttcaaagactgagaaagtaaatttaacaaacagaaagataaaattactaatatgagggcaagttgacattcctgaaataataaaaaaaagaagaaattggtacatggtacatattgaagacttctttaaataattggaagtaatttgggcaaaatgagaacaatcaaagaagagacgaaagaatatttatggtgaattaacaattattgaaaaccaatagattagctaaattggtgaaattaaaaatgaactgagcatgccatgtacatcaatgtccaaaagcagccattctctgtggggaaaggtgagtgttggctcttcctagagacaagaggtccttcataattaggttcacaggcactaattttagagtataaaatgcagcttgctgattaacacatgaaacagaattccaggctgaattattatttacatttaaaagcacctttttaaacctcttaaattaaaataaatgtatagtttattaaaatattataagatgatcacccctgcaaaccactacccagatcaagaagtataacttgacaaaacacagaagctgtgtctcaatcacaatcgtgtctcctcctctaaaaataaccactctccttatgtttaagcttccttgaaagttacatcactcaaatatatacccctgataatgatagttttggtttgcttgtttttatttttatgtgtcttttgagtcccttttagtctatacgccacacttctttttattttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccgtttaaccctgagtggacacagcacatgtttcagagagcacagggttgggggcaaggtcacagatcaacaggatcccacggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggccgaccccccaacctccctcccggacagggcggctggccgggcagaggggctcctcacttcccagtaggggcggctggccgggcaggggggctgacctcccccacctccctcccggacggggcggctggccgggcggggggactgacccccccccacctccctcccggacggggcggctggccgggcggggggccgacctccccacctccctcccggacggggcggctggccgggcagaggggctcctcacttcccagtaggggcggccgggcagaggcgcccctcacctcccagacggggtggctggccgggcggagggctgacccccccacctccctcccggacggggtggctggccaggcggggggctgacccccccacctccctcccggacggggtggctggccgggctgaggggctcctcacttcccagtaggggcggccgggcagaggcgcccctcacctcccggacggggcggctggccgggcggggggccgacccccccacctccctcccggatggggtggctggccgggctgaggggctcctcacttctcagtaggggcggccgggcagaggtgcccctcacctcccggacggggcggctggccgggcgggggggctgaccccccccacctccctcccggacggggcggctggccgggcggggggctgacccccccatctccctcccggacggggtggctggccgggctgaggggctcctcacttcccagtaggggcgaccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggcccgtccgctcctccagccgctgcctcccgggcggcgctcgccggcctatacgccacacttcttatcgccctccttgtctgcaatttatttaagaaactgggtgatttaacccgtgaatttttttacagtttggattccaatgattgcataatcaaaaggtagtttaacatgtttcttgattctctgtggtttctttaaagtagttattggtctaagatgcttaaacttttaatacattgactttagacagcttcaactccatttgcaatagctactatgtgacctctgaatttttggtaggcaagaggtaaagcaattgcagcccagaacatcatgtggagccaggaaatgctgctaggagagagggtggctaagctgacagagttgagggcagttttcctggatcagtttagaggccatgtgcaaaacagaaaccttgcagcaggagggaatgacttatcaaagggaagtggtatctggaagtgtctaggaatggacagaagtcagtacttaacacaggttgactgggaaaatgctgggaagtaaatagagaaaggcaagtataccctgggttccttcaaagcagttcaggaaaatattctctaaatgatggtggttacatgcaacgtaaatgagttgatcaggaatgctccaggtccaccagcatgttaaacttttaatggttgagacgttatataatattttctggtaattcaaagtcttagcaaaactttgtggtaaggatatttgtcccatatttcagataactctaagaatgctaggaaaggggaatatgtcaacaagaaatgttacatgtatggctggatgctattttctattttttccctttccttcagtcaagcatgtggcctggtttatgcttccttacctcacagatatttcagaaagcggaagtatcagacagtaatccctatttatgttctcaaaagccaagcccataggagatttattaataaaagatttgtaaataagtaaaaaaggaaaagagagcttttaataggtggctgaaagggttagaaaaaaaaatgaaggaagaaaggaatttctccaatggtctacatacctttcccgcgcaaaatggaggaacagaaaagatcctgggggtctaagacttgggccagaagttctggaagtgccttgaagagtctataatattttaaaaagggatacatgcatggtgtggctagggacttaggggctaggcatggggttcccaaccttaggacatttcctaagcgtgttacggaagcagtctggggatctgaaagaactgtaggagtgggggacagtaaatatcttaccagggactttctctgtgcatgcaacatctgaaacccctctccccaaccaaacctcaatgccttggccctaaataatcctccagagacttgggggtgtggttggggttagagaaagtctcaagcatgagaagtgagaagcttagaagcagcaattaggttgacacatgttctcacttataaccgggagctaaatattgaataacacatgaacacaaagaagggagcaatagataccagagcctacatgagggtagagggtgagtggagggtgagatttgaaaaactaccttttgggtactatgcttattacctaggtggtgaaataagctgtacaccaaaccctgcaacacacagtttacccatgaaacaaatctgcacttgtaccctcaaaacctaaaataaaagttggaaagaaaaaaaagaaagaacaaaattaagttgacttatttttaataggcttttattacacatcagagtttgtgggatgaaatctgtctccattacccaatgcaaaaatcactgggaaaattagtataacaaatgaccgcaaacacttacatagtacttactatgtattaggcgttgttctcagcttctacgtgtattaacacatttgatcttcacactacttactttagagaaagatgtcattattcctgatttaaagaggaggaaattgaagcaggctaacgttaaagaacatgcttaggattacactgcagctgacaagtggcagggtcagcattcagagtccatgtgggtagtcaccactccaagctttctctccaaaaccgctgactcaggcacactttttaggttaaagtaaatcaggacttatgaagtgaaatgtcagttttctaatggaggaaccagatccaaaatataaaaccctctttaagataatttttaagatgagcaggtgccagctgactcctccttcttgataatgcttaggtgctttggaaactcttcctggatgagaaagagattcttgtccctcttcatctgctgcaaaggacaaagccccagaagaataatatgccaaagtcggccttaacatctatcatccctataacctcatctccctggtgctctgaccttcactgggatggtataaagcagaggctctagagtatccctggaaatgaggagcagcgtacactaaccagtttggtttagagtaattctctcctatttgtaatttttatgaaaaacaatttaaatatggccttggactcatgatattttttatgtcacaataaagtggaaatttaaagttacaaatccccaaaaaggtcctccatcaactcctcataggatgtatccatttttagctctgattattgcagttaactttccaaagtgctgggattacaggtgtgagccaccacgccagcatatttactgtgaaagtttaaaatctgatttgaaagctgcttattataagcaatataattttttctttaacggccccagaatgtttaatgttacataatatgaatatatattttcaaatgtaaaaaaaagcctttttatatataaacatgtataaaagaataaatataaataagaaattaattggggtggcaaagtacatttaaaattttgtgatgtttttgtcaaaaacgatttgaacaaatttataggaaaaaaacaaacaaccccatcaaaaagtgggcgaaggatatgaacagccacttctcaaaagaaaacatttatgcaaccaacaaacatatgaaaaaaagctcatcatcactgtcattagagaaatgcaaatcaaaaccacaatgagataccatttcacgccagttagaatggtgatcattaaaaagccatcattctgagcaaactatcgcaaggacagaaaaccagacaccacatgttctcactcataggtgggaattgaacaatgagaacacctggacacagggcagggaacaccacacacccgggcctgtcgtggggtcgggggacgggggagtgatagcattaggagaaatacctaatgtaaatgacgagttaaaggatgcagcaaaccaacacggcacatgtatacatatgtaacaaacctgcatgttgtgcacctgtaccctagaacttaaagtataataataataataataataataataataataataataaggcaggaagcaacagatgctggaaaggatgtgaagaaataggaatgcttttacactgttggtgggagtgtaaattagatcaaccattgtggaagacagtatggcgattcctcaaggttccagaaccagaaataacatttgactcagcaatcctattactgggtatatacccaaaggattttaaattattctactctaaagacacatggacatgtatgtttattgcagcactattcacaatagcaaagacttggaaccaacccaaatgcccatcagtgatagactggataaagaaaatgtggcacatatacatcatggaatactatgcagccataaaaaaggatgagttcatgtcctttgcagggacatggatgagttggaaaccatattctcaacaaactaacacaggaacagaaaaccaaacaccacatgctctcactcacgagtgggagttgaacaatgagaacacatgggcacagggccgggaacatgacacaccagggcctgttggggggtggagggctaggggagggatggcattaggagaagtacctaatgtagatgattggttgttgggtgcagcaaaccaccatggcacatgtatacctatgtagcaaacctgcaagttctgcacatgtatcccagaacttaaagtataatttaaaaaaaaacagtttgaaaacttccctgaagtaaaaaaagtatcctttgaggaacaatgtaacgatgagctcaagttccacaggaaagagaaaattaaaatttataaagaatttataaatatcaaactattttcatgttttccaggaaaagtgtggctttctcattcattaaccaatagcataatattttccaggaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaaca

SEQ ID NO: 2512 - DNA, 61353 bp, Homo sapiens
cgtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacaggtgagtccccctcgtgggtgcggcccgggtgccacctgcaggccccgccgccccgctgcctgcaaggcccggaagacccctctgtgccgctgggaagtcgcagcttgcggactggggagcgtttcacttgtgcgggttggagttcgggaagccgggagaaacagctctccctggggtggcttcttgggggtgggtggctttgaggggaacctgcgatttatgggaacattgtaaagaaacacgtgacctcggcgatgctcagaagtaggttctgcccctgccacctcgggcagaaggcgggcaggcccgggcgcccctggtggagtcagctggggatcccctcgctagggcaagggcgtgggcatcgcctccctcggtgactttcttccttgcctgatgccacagcaaccggatgggggagggtgagagggacaaaagtttgccacaaagtttggaccaaccaaacacattggtttctttacaaaataaaaaaccagttgtatttttcttctctcccattcaagagcagtggtatctcttgccttctccatccctttgagctccatttttttcttaatcctaaccttttttccccatcccaaattgcttatagagttagcacgacatcagtatgagctggtcaccttccctgacaacgcagacatgtggggcctgggaaatgaaagagcgccttgggacagggggatttggaaatgtcatccgatggcacaatcaggtaggccctctgtgcagcttggggaggggcggggagccaggccccctcctcactgcctccactttctctgatcctgctgggccaagggctcacctttggctttggtcatcttgggacagtgaatagggggactgggaagagggcttcaggacttctgagctgactccaggttagtggtctccatgctttattgactatgtcacctaaataaatagtaaaataaagttaagctcttagtctctattatatatatatggtaacagtagaatatcatgtactaatatatactgatattatatgttataaaacatatagaaataggaaaatttaaaggatgagactaaataaataatttaaaatattttaattccttgaggccagtagttcaagagcagcctgggcaacatagcaagacctcgtctctacaaaaaaggtttaaaaattaggcagccagctgggcgtggtggcttatacctgtaatctcagcactttgggaggctgaggcaggcggatcacgcagtcaggagatggagaccatcctggctaacactgtgaaaccccatctctactaaaaatacaaagaattagccaggcttggtggcacgtgcctgtagtccccagctacttgggaggctgaggcaggagaatcgcttgaacccatgaggcggaggttgcagtgagccaagattgcgctactgcactccagcctgggtaacagagtgagactccgtctcaaaaaaaaaaaaaaaaaaaaaaccttaggcagccttggtgcgtacctgtagtcccactacattggaggctgatgtgggaggattgcttgtccaggagtttgaggctgtagtgagctatgattgtgccactgcactctagcctaggtgacagagtgagaccttgtttcaaaaccattttttaaaaattattttaaatgtcgggtgcagtggcttacacctgtaatcccagcactttgggaggccgaggcaggaggatcacttgaggtcaggagtttgagaccagcctggccaacatggtgaaacctcatctctactaaaaatacaaaattagctggtgtggtggtgcatgcctgtaacttcagctactcaggaggctgaggcaggagaatcgcttgaacccaggaggcagaggttgcagtgagccgagatagtgtcactgcattccagcctgggtgacagaatgagaccctgtctcaaaaaatatatatatatatatatatttaaaatatttgctaattatgatgtcttcccagtattgcttgcgatactgcacggcaaaaaataagcagatccacatgaaagtgagaattcatttagaatgatgatgaaaatccatatttcaaataattaacatttttttaaattttgtagagatggggtcttgctatgttgcccaggcttgtctcaaactctcatcctcaagcagtcttcccgtctttgcctcccaaaatgtttggattacaggcctgagccatgggacctggcctcagctgaggttttttttttattttttgtagtgatggtggtctcacaatgttgtccaggctcgtctagaactcttggcctcaagtgatcttcctgccttggcctctcaaagtgctgggattacagccatgagtcattgaacctggcctgtttttatttttaattgacacataataattgtacatatttatggggtacagtgtgatattttgatacataatgtgtaatgatcaaatcggggtaattggcgtgttcatcacttgaaacacgtatcctttttgttggaaacagtcaaaattctttcttctggctattttgaaatatacaatatttttttttttccggagacagagtctcgcactgttgcccaggctggagtgcagtggtgtgatcttggctcactgcaacctccgcctcttgagttcaagtgattctcctgcctcagcctcctgagtacctggaattacaggtgtgcaccaccatgccagctaatttttgtatttttagtagaaatggggtttcaccatgtaggccatgccggtctcaaactcctgacctcaggtgatctgcccacctcagccacccaaagtgcttggattacaagcgtgagccactacgtccggcctgaaatatacaataaagttttattcactgtagtcaccctgttgttctttagaatactgtaacttattccacctaaccgtaattttgtacccattaaccagtctctccctatttccctccacaactccccccacccccaccaccctttcctgcctctggtgaccactattctactttctacttctgcgagattagtttgttgttgttgttgttgttgttttgagacggagttttgctcttgtcgcccaggctggagtgcagtggcgcgatcttggctcactgcaacctctgcctcccaggttcaagtgattctcctgccccagcctcccgagttgctgagattacaggtgcctgccaccacacctggctaatttttgtatttttaatagagacggggtttcaccatgttggccaggctggtctcgaactcctgaacttaggtgatccccgccggcgcgcccccccccccccccgccatcccagcctcccaaagtgctgggattacaggtgggaactaccgagcctggacgagatcagtttttttttgtttgtttgttttgttttttgagatggattcttgctctgttgcccaagctggagtgcagtggcacaatcttggctcgctgcaactggtgtctcccaggttcaagcgattctccagcctcagcctcccaagtagctgggattatagccgtgcaccaccacgcctggctaatttttgtatttttagtagagacagggttttaccatgttggccagtctggtctcaaactcctgacttcaggcgatctgcctgcctcggcctcccaaagtactgggattacaggcatgagccactgtgcctggcatttttttttttttaatttttaatttctttggagatagggtctcaatctgtcatccaggctgagtgcagtggtgccatcatggctcactgtagccttgacctcctgggctcaaatgatccttctgcctcggcctcctgagtagctgggactacaggtgtgcgttgccatgcccggctaatttttgattttttgtagataggaggtctgtctgttgcccaggctggtctcgaattcctggacacaagtgatcctcccacctcagcctctcaaagtgctgggattacaggtgtcagccaacagactttacccaactgagatcagttttttattagctcccacggatgagtgagaacatgtggtatttatctccctgggcctggcttaattcccttaatgtaatgccctccaagctcatccatgttgccacagatggcaggatttcattcttttttatggctgaataagagtacattgtgtctgtgtaccacattttctttgttcatttgttcattgatggacatttaggttgattacatattttggctattgtgaatagtgctgcagtaaacgtgagggtgcccatatctctttgataaactgatttcctttcctttggatagatacccagtagtgggattgctggatcatatggtagttctatttatagtttttcttttttttttgagacggagtcttgctctgtcaaccaggctggagtgcagtggcatgatctcagctcactgcaacctccgcctcccgggatcaagcagttctcctgcttcagcctccaagtagctgggattacaggtacatgccaccatacccggctaatttttatgttttcagcagagacggggttttaccatgttggtcaggatggtctcgaattcctgacctcaggtgatccgcctgcctcagcctcccaacctgctgaaattacaggtgtgagccactgcgctagccttgtttgtagtttctcaaggaacctccatactattttccataatggctgtgctaatttacattcccaccaatagtgtatagagttccgctttctccacatccttgccttcatttgttactttttgtctttctgataatagccattttaactgtggtgagatgatatctcattgtggttttgatttgcatttgtctgatgattagtgatattgaacattttatcatatacttgttggccatctgtatgtctgagaaattcctgttcaaatcatttgcccatttgaaaaattggattatttatttttttgctgttgaattgtttgagttccttgcatattcttgatattaatcccttgttggatggatagtttgcaaataatttctcccattccataagttgtctccataggttccataggtttattctgttttttcttttgctgtgcagaagctttttagtttgatgtaatctcatttgtctacttttgcctctgttaactgtacttttgaggtcttatccataaaatcttttcccagaccaatgccctgaagcacttcccgtatgttttcttgtttttttttttttgagacagtctcactctcagctgagacaggtgcgatctcgggtcactgcagcctctatctcctgggttcaagcgattctcctgcctcagcctcctgagtagctgggattacaggcagcgccatcacacccggctaattttttttttttttttttttttttgagacggggtctcgctctgtcgcccaagctggagtgcagtggtgtgatctcgggtcactgcaagctccgcctcccgggttcatgccattctcctgcctcagcctcccaagtagctgggactgctggcgcctgccaccacccccgactaattttttttttgtatttttagtagagatggggtttcactgtgttagccaggacggtctcaatctcctgaccttgtgatccgcctgctcggcctcccaaagtgctgggattacaggcgtgagccaccgcacccggccacgtgtggctaattttttttttttttttttttgcaacggagtcacgctctgttgcccaggctggagtgcagtggcttgatctcggctcactgcaacctctgcctcctgtgttcaagcgattctcctgtctcagcttcccaagtagctgggattacaggcacctgccaccatgcctggctagtttttatatttttagtagacacggggtttcaccatgctggccaggctgttctcaagctcttgacctcaagtgatctgcccaccttggcctcccaaagtgttgggattacaggcatgagtcactaacaggcgcctggcctgttatttatttttaaaaagccaaaagccagcttcctcctcctgccggctgaaccccacacagtctgtctgcacctgcctctccatcattcctccccttggctgcctctgttttgagcgctgagccctcttgccggacaggcctccccctcctccacattcctccaggaccaactctaggccatctcctcctcatatgcgtctgggatggctttgttctgtggcaactggttctcccggtgagttcctctgggctggttcctgtgccgcccttcctgtctgcgtgtggagtaagtcttgtcaggaccctgcattcctggtcagccagggctgggtctggcctttggagttccttcagttctcctgtagcaagtgcctgacgttgtatatgtgctaggtgccccaaatcatccactctgccagtccacaaatatttatcgaatgtctattatgtgtacattggtaattaaagcagacctttggagaagggaaggagccattagtcaactaattataaatgtaagctcctaagtatggtaaagtgtgagttgggagaaggacccagtgcactgagaccttccgttggggtgggatcagtcagtgtcagaggaggttccccaaggaagtgacacttgaactgaggccctagtagaagtcagcttgacagagaaggtgggaggagagttccaggccaagggagaggctcctgaggggcctctgtggagggcaggtgtggcaagtgggcaagactgaaggccagcgtggccggaagggaggatggggcacaagtgcctgggtggctgagggtggacggtgcaagtcagatcctgtggtgttttttgggcagtttcagccgaggaggttttgttttgatggaggagcagtggaacgatgttagagggaggcgctgtgcccatggggacagattgggagggcccaagcagtgggcagcgtgctgggaaaaaatcagctctcggaagaaatgccttgatccatagtgtgcagcagttctcatggagtagctactcccaccagggctgacttcaagccaccagtagtttaatagcccgctccggcctgattcctgagtagttaacaaccagctctcagtgactgctactacagtgtcactggctccgtcccagtgatgcaggcagaccaggtctgaatgttttggagtcgtctaggtgagagatggggagaggtgggcagacttaagagatatttagcctggtgcagtggctcatgcctgtaatcccagcactttgggagcagaggcaggtggatcacctgaggttgggagttcgagaccagcctgaccaacgtggagaaaccccgtctctactaaaaatacaaaattagccaggcatggtggcgcatgcctgtaataccaactactcaggaggctgaggcaggagaattacttgaacccaggaggtggaggttgcagtgagtcgagatcgtgctactgcactccagcctgggcaacaagagcgaaactctgtctgagaaaaaaaaaaagagagagagagatttaaggggtggaattaacagcgcttagtggtggagtagaggtggaggggagcaggaggagtggagtgcctgcaggtcctcaatgatgcctacccgtgagcccggcccaggccaggaagctctctaccttccttccccgtgggttctccccaagtttgggaaatctctagggctgctttgggtgctgaggagaagtctttgatcattgtccaagttcagaagatgagcgtgtatgttctctgttgggaacccctctgttcacagcctcttaaaagaagcagctgggctatggtggtgttggttccttgactctgatggttttactccacgtaacaacagtgtgcactttcctgacactccatgcactgcatcttgtctgcagaagaaggaatgttgtagttatcacaatagaagttacatgaaaaagcccctaagcatgggtatcctcagtcagagaagtggcctgataatcagaggcatcatttactgagaacctgctatgcgccagcatcaaactaggtatttacgtgctttctctccagccctcacaactctgaaaggaagtactgttgtctttgttcccattttatagttgaggagactgaagcacagtctctgtgactcacccacagacctgagctcgcaagcaaagaggctaggattggaacctgcgtctgttcggaacccaacctcatgctttttccattgtgcctgtggcttctctgtggtgaggactcagggggaggccttggtgttccttaggctctcattgttcaccacagtctaaacctttttgaagcaggaaggggaaaacacttctttattgattttttgttgtttgttttttgagacagggtctccctctgtcacccagactggagtgcagtggctcgatcagggctcactgtagccttgaactcccaggctcaaggagtcctcccacttcagcctcctgagtagctgggactacaggcgtgagacaccacgcctggctaatttttttatttttgtagagatgaggtctttctatgttgcccaggctggtctggaactcctgggctcaagcagtcctcctgccttggcctcccaaagtgctgggatttcaggcatgagccactgtgcttggttgaaaaacacttctttggaggacaaaacacttataagtcttccttgttagacagagaaccccacattgagtgtttcccagggagggagggcagtgaacaagcgagccccaccacaacctgcttcccctgttcttgtggttctcctgccacgcgggcctcaccattccacattgtgtcgggactccctaagacctccagcccaggggtcagcacaaaccacttcccagtaccgtttagataggctgatattttcaatgagacctttgttaaatacaaaggaagaggaggaggagataaccgagtgctcccacctggcagcatgttttgggagtgggggcgggaaacacgatactcagtcacacagacctgggttcagatcctggctctgtcagcgtcttggctgtgggtccccactttttgcatggattatggggattctccaatactgatctcctcagtgctgggtccccaacatggctgggcaggatgtgggtcagctaccttctggaagccacccagggtaccttgtgatatcatcatgttctgtgtacacttggctgtgaggagggccaggaagcgctgcctggggccctgcgggatgctcgttggggtggaggaggcagtgtgtgtactggctgttagaaggcagagtattaacgatcccttctatgaagcagcacggacctgtacttgtccctttatgggacaaggcaaagctttccacagcttatctgtgtgcttggaagccttaaagcctctgctccgttcagtcacttctctagggatttatagagcctgggcccgagctctgtcagggataccaggaaaaaagggtccctgcccttcgtgtgcttactctctgatcacagtgatccagggagcattcagaaatgcattaagtgagtctaaatccaagcaccgaactgcatggataacagtggctgccatttttccagggcatcatgtggcatctgagctgggttccctgtccgcatgatctctcccgaacgctggggaagggaggcttcttggggtgaatggagctttagcaggatctggaaaggaggtacactttcgagggcctggcaagaagacagaagccgactcaggtgggcagagcagcatctccacagggccagaaaaggaagtgaggctgcggtcgtttattcccggctccctgtggtcggatgctgtgtttcattttagctgacatccctggagtggatggagccatccccatcttatggatgaggacccagatgcttgtaccatgggcttctatcgcacctttaccaggcggtgggggagggagttacacctggacctgcttgtctcctgagcccgagtgcctggcttctgtgggtgaggcggcaggccactgtgccccttgggggtctgcactgtagggagtagggtgaagaagtcatggccctcttagcgtagaccaggcgatgctggggcccagggtctgtccagttacctgctgagccaggggtgaaactgcagctggatcccggacctttttggctcccagccctgggtcctcctgcccagtctctctggtcccagccctgcacctcctttctgaagcattcatttcagggggtggggtctgagaaggaggaggaggtttttactaattgcccccatgtccacagtggcctggttggatgcttgccatgataacgggacactgggctttctgcgctaagggtctaaacatggctcttggcctctgtgagtttcccctgagtcgctggaagaggcaaacttgaggaagctgggccccttttgtttctcctgtgactgggtcttcagctcgcatctgccaggcaccttttggtctgaggatgtgctccccctctgccttttttacaccttatgacacacatgcttatatataagttttatgtttacatgcatcaaaggcaaggaattgcaaactctgaggaccttcataatcactacattcaatctggacatacaggggaccctttctccgttttctcaaaatacagaccagttttttgttgttttgtgtgtgtttattttttgagacagggtctcactccagtagtccacgctggagtgcagcagcatgatcacagctcaacgcaggtctcgctctattgcccagccttgacttccgagggtcaggagattctcccacctcagcctcccaagtagctgggactacaggcatctactactatgcctggctagtttttaaaaatatttttagtagagacagagtcttgccatattgcccaggctggtctcaaacccccgggctctagcgatctacctgccttggtctcccaaagtgctgggattataggtgtgagccaccatgcccagccacaaagcagttttaagttttgtccttcacgaggagttcatataccagaagttgggtactgagatggcgcaggcctagtctgggtttccacagaactaagctaagactcagtagattccaggaaaaataaagtaagccatccttcttaccttacatgtgtttgagttccactgctagtgaagaacaaactccctggggtttcagaaccggtgatcgtagcctgcttctgttttaattgaattttgctttctagagcaggtatgtttttagtaacaaagtcattctgtttgcatttctgtttcaaatgaaacattactcatggaaaaactgggaatatttcggaatacttcctagaggcagatgaaggccactgtgttaggaaaagtttaagtatgtctgtatctacgcagaccttcctaggcccagggagttaggatttcgcctcaactctagggcgaagctgagctgtctgtgagtagaaagttagttttggtatctatgcccagttatttcaagacttgttcagtgttcacattgctgagttcagtctttttagtttgcatttggatatttaagaccaatatcaagtcttcagtatcagaatctcctcctgattctgggttgggccaagtgacagctgtgtatcaggtccagtgtttgtgttgggcaaaagactgcaattatccaatttgtagctagacagattacctaaaatcacttaataaactaagtcatctaatctattttttggatctgatgatctgtcctgtttcatttatgataggtagaataatcccccccaaccccaccaagaaatctggatcctaatccctgaacctatgactgggtggggcagcatggcaaagggaaattaaggttgcagatgaaattaagttttctaatcagctgaccttagagattggcctggcttccctgggggtcccagtgtaatcccaagggttcttaaacgtgggagaaggaggcagcagagccagggtcagccgatgcatgtgaggaagatggcgggacatggctgacacacggatgggctaaggggctacgagctgaagaaagtggcgcttctagaagatgcagaaggaaaagtagggaaacagactctcccctagagcctctggatggagcatagccccaccaacatcttagctcagggagacccacatcaggcttcagcagatagaactgcaaggaaataaagtgtgttattttaagccaccaagtttgtggtaatttattacggcagcaatagaaaacaagtgccctcttctgtgtattgaagttacgttgctgcagatttttcagtatcttggtttagtctcagtcattctaaggtaacgaaccataagttacagtctctttggctaaaccattgcttggaatagtgtccatggaaatgttgcagggtggatggaggtggatagatgctcttggcaatggcacctcacgctgcagcggggccatcggtctctgtttgtggaaccctgcgttccccacgtctgagctcctctgcaaactccgcctaactggaggcaagtgtctgtagcagtgtctcagtcggctcagtgctgctatcacagagtagctgagaatgggtaatttataatgattttatttctcatagtcctagaggctatgaagtccaaggtcaaggcatcatcatagggtgaaggcgaaagggcaagagacaaaagggaccaaacttgtccttttataaccatcagtcccacctgggatgcagagccattgtggccgaattgccccttaatactgaggtgatgtcctggcgcagtggctcacacctgtaatcccagcactttgggaggccgagacgggtggatcacgaggtcaggagatggagaccatcgtggctaacatggtgaaaccccatctctactaaaaatacaaaaaattagccgggcgtggtgatgggtgcctgtagtcccagctactagggaggctgaggcaggagaatggcgtgaacccgggaggcggagcttgcagtgagccgaggtcgtgccactgcactccagcctgggcaacaaagcgagactccgtctcaaaaaaaaaaaaaaaataccgaggtgatactgctacaacaggaattggctttcattgaattatggaaaactgtggaacttaagccatagcagatatcgtcaggcagagctgctgtggatgaagctaccacagaactgggcaaaaatgtgtctgagcactgtggggaagtgaaacctgaaagcaaattcacgtcagcctgagaacagaccaggaatcgggaggtacagggaggtgtaacatggtctgcacatcaattaaagaaacgttattcttttttttttttttttttttttgagacagagtctcactctgtcacccaggctggagtgcagtggcacgatctcggttcactgcaacctctgacaccagggttcaagcgattctcctgcctcagtctcccgagtagctaggattacaggcacccaccattgcacccagctaattttttatttttagtagagatggggtttcaccatgttggccaggctggtctcgaactcctgacctcaggtgatccacctgcctgggcctcccaaagtgctgggattacaggcatgagccaccgtggctggccagaaatgttattcttttgacacattccctaattcttgaaaagcttgagatggacttgtgtccaccatggtttgtaccactgtactaatcagtttaatagcaacaaggtggccgggtgcaggggcttaggcctgtaatcccagtgcttagagaggctgaggtaggaggaccacttgaggccaggagtttgagaccagcctgggcaacatagtgagactccgtctctacaaaaataaaataaaaataaaaaaaattagctggacacaatgacacatgcttgtaatcccagctacttgaagctgaggtgggaggatcgcttgagcccaggagttttaggcagcagtgagctatgatcactccactgcactgcagcctgggcaacagagtgagaccctgtctctaaaaagaaaaaatagcaacaggttttacaattgttgagagaggtcagctcttgttcagagagcgcctcagaatctaggccaaagatcagggttctactagacaaagagaatgagaaggatacttagggcagaacctggatgcccatgcctactgccgcagactggactgagggggtctcccatagtcacagacgtaagcctgtggctgcaccatgggtgagccttggaaacagtgctcagggaaagaagcctgtcacaaaaggccacatgatatatgattccatttatatgaaatgtccaggacaggctaatccgtagagacagaaagaggtgggtggttgcctaggactagaggggctcggggagtagggagtggctgctgatgggtgtggagttttgttgtgggatggcagacatgttctaaagtgtgccgtggttttggtctcacaactcttgagtatgccagaaactattgaactgtgtaatttaattggatgaattgtatggtgcatgaattattctcaatagagctgttaaaaaaaagtaggcatgcaaggtcaccatctgatggaaagcttagccaaagtggtattgggctttgatgaaagcagcttctgagagtattttagaagtgttgacagtacctcctttctggcatggagtctgctgttccatttccacctttttttctgaagcttttggttcttggtgtcggtgttaaggattggtttattggtcagtgactcagtggtcttattagacagcttctggtgtatgtggaggtttccatttttccttttcttgctgtgaaggtccttgttcctgcagggatcctggccagtttggtaactgtgagactgaggtggcttgagtgccatgggaacagccacactgggaggccttgccacagtcctctgtgtgtctttttttgtttttgtttttgtttttgttttgaaacagggtcttactctgttgcccagatctcctgcaacctctgcctcttgggcttaagcaatcctcccacctcagcctcctgagtggctaagactacaggtgcatggcaccacacctggctaatttatgcatttttttgtagagatggggttttgccacgttgcccaggctgatctgtgtgtctttttaagtcccattcagtaccatgtctgttgctcacttacaagatttatgattcttttcagtttgcatcttcataaactgagaaaacagaaattggcctaacagggcctctaggacatccttcaagtgagccacagtagagtctggtacaatgctgaaatcttctcctactgctgggtgccctgtgccaccctgcaggtgtggctcttgcccaggtgtgtgtgcgggtagggagtttcgtgctgtaggtacacaggaggtgcaggatgttggtgcaggtcagcttgtttagcagtggcaggatcggctctcaggctggggctccgggagctgctgccttgggcagctgctgccccgcagttgtcttggagacccccccatagccaaaagaggtgacagtggtgcagtggtgactcccttgtggcagctggagtgcccgaggccagagccgctttccctgctgcccgtgccacagcctcagggcctgcccgtctccagtgtccccactcatgcaccagggagaagaggggaggccgccaggagccagtggctcagctcatgattcaccaggtggaggagccaccgctgaggatgctgctggttacctcgatagaggttaaagcccatgaagatggacaagtctataatttaacaaagagaagagaaaacagcctgttactctgcagaaagtaactctttggcatgtgcactgaaggaattacctgttacaggagtatagcagagggtgagaccctcttgagctcggcagaccgtggtgcccatgcacctgtgctggcaagtgtagcagagcagggccaagcgccagggtgggtggggccgtctggctgtagtgtcgtgggaagagtggctggaaatgcagataggagccaatctctgtaggatgttaaacaggagtactcggatgacctgggttccctgctctgcagggttactaatacctgctagaggcttgttttcaagccctgaaagatgggtgtcagtattcccattttacagaagaaactgagtcagaccaagtggtttacccaaggtcacacagctagtaaatggcacagttggaatttgaaccagccagtgtttcatctgctatattatgccatattatgcttgcgttctctctgaaaggacaaaactctcacatgaaacaatgaagacactcaatgtggtgttcactattaggttgaaccacatgcaggtgccatttttgtaggtcaatgtggtcaattatcagcagtgtcccatgggtcagcctaatacagcagcagccggggttcggacagggaaacctctctgcgcaggaatggtcagtagaggtttcatggcggagctgggaatggagcagggccttgaaggctctgtagactctggatggatagaaatgaggtgggagaggctgggtgcggtggctcacgtctgtaatcccagcacattgagagtgcgaggcgggcagatcacttgaggtcaggaattcaagactagcctcaccaacatggtgaaaccccgtctctactaaaaatacaaaaatttgccaggtgtggttgcgcatgcctgtaatcccagctactcaggaggctgaggcacaagaatcacttgaacacgggaggtggagtttgcagtgagctgagattgtgccagtgcacttcagcttgggcgacagagcaagactccatctcaaacaaaaaaaaaaaaagagagagaaagaaatgaggctggagaggttgggtgagaggtggagtggtaaggagacagcccaaagggcaggtgctacgtggctgtcgatcagggtgtacatgtgaccttggagcaccaggaggtgattgcaggtaacgcttggggcctggagacccctcccatgcagcagacagggtgggatttggcctgcagctcgctctgctggtccccactgtgctgtttctgtaggaaacaggtgagcagattgccatcaagcagtgccggcaggagctcagcccccggaaccgagagcggtggtgcctggagatccagatcatgagaaggtgagggcctcgcgcatagggacccaagggaaagctggagcagcagcccccggtgtgtctagaaaggagagtcttgctgggtgcgtggctcacgcctgtaatcctagcactttggaaggccaaggcgggcagatcacgaggtcaggagactgagaccatcctggctaacatggtgaaaccccgtctctactaaaaatacaaaaaattagccgggcatgggtgggcgcctgtagtcccagctacagagaacaccagggaagggggaagggcatgctgcacactctgctgggattactccaatgacaaggaaaccccgtctctactaaaaatacaaaaaattagccgggcatggtggcgggcgctgtagtctcagccgctcgggtggctgaggcaggagaatggcgtgaacccaggaggcggagcttgcagtgagccgagatcaagccactgcactccagcctgggcaacagagcgagactccgtctaaaaaaaagagaagagagtcttaaatatctgcccctccatcagggcgccagcctggcagtctccacggtgactctgctgcttctaaagacaccagaggaagagcagctaaagtccacactgggccttgtcaagggctgttcatcaatttcattgtattaaataagttaacacagttatcacagtgacttttcttttgtcagcaaaaaaagccttctttcctcctatatttccagttccaaggtggtatgtgaccgttctctgctgtcatgctgtcgctgacatttattcctctagtgtggagacggggctgtccatctgcctggtggctgctgaccccctagctagtgaggcgtgaggtgggctccgaaagagccagtgaggaggacaccaagcaggggctcctctgccagcctcttaaaaagaggaggtgctatttggttatgtcatggttccatttggttacatgagttccttctcagacccttctctgtgtgtccaccttggggtgatgtgtgtgcgtgaaccaacctgccgaaaattaaacagacaaaagaaaaaaaatatgaaaacaaaaagagcaggcaccaccttgtttgcctgcttgcgtgtgtgacacatcctccccatgtggagggcatgagattgaaaggtccttgtaggagcagtttggcagcacgatgaggacttgggatgtggcacgcacaaaaaactgaagttacacgcagttgtgccctcagggtctgagttctggtgctgtgagtggggctgggtgagcgccactgacccaggcattgcggttggccacccgtcctgggctctgtcttcctctgtttcaaagccctgggttatcctgggcctttgttgctgagacctggtgggggtggtggggatgggtctgggcaggagcctgggtctgctctcatcggttttcctcctcctaggctgacccaccccaatgtggtggctgcccgagatgtccctgaggggatgcagaacttggcgcccaatgacctgcccctgctggccatggagtactgccaaggaggagatctccggaaggtgaggctcccacggctgccaggtgcacagcctgtctgggcaggtgggacaccaggaagagggatggggagacctttcacttctgtcatcatcaggaagcttggggagccccagtgactccagcagggctgctttgcctctcagatcctctgttccctgcccacctggggctggtgtgtgtgtgagtcagaggcgcttccgagaacaccagggaaggggtaagggcgtgctgcacactctgctgggattactccaatgacaaggaaaactcatcacaggtctgggcgtggggaaggactgggcaagttccaaaacaaatgcttcctccctgggcatgttagggccacgttaggcctttggtgccagtgccactgctctccttattaggagggattttattctagagatgggacagcaccacacacgggggcagggagcatagcagagagggagcaggattcatgatcagagagccgggccagggctgcagacccgccccaatccatccgatccacctgacccacctggactcatctgtggggctctattctccaccttctcaccacaccacctcctcttccctagaatgttcacttctggtgggtggatggcagcccctcctggtctcaggggcagttgggtgccctcctccccattgttccctatgacagtaccacacagcctgctagtacatgttacctcattcgatttccaaaagctcacacatgggtgcacaggtatggttcccacatgatgggtggatgtcatggcccagagaggttgggcctcacacagctgtagcagcagagcctgggtcccagcccacacagacccagctgcaggccacctctccatctctgaggctgaataaggccatataacattatgaaaactggaagctctgaacaaaataatttttttttttgagacaagagtctcgctgtattgcccaggctggagtgcagtggcgtgatctcggctcactgtaacctccatctcctgggtccacgtgattctcctgcctcaccctcccgagtagctgggattataggcgcccgcccccacgcctggctaatttttgtatttttagtagaggcagggtttcgccacatcagccaggctggtctccaactcctgacttcaaatgatcacccacctcaggctcccaaagtgctgggattacaggtgtgagccactgcgcccagccaacaacaatttttattttaattgaaaaagaggtcggttgctctgcgagtgcacctcttcactccagaagggtcacaatagtgggggcgggagcccaggcgtttattcctgttcagtggccattcccagacacacttcaggtgctgttctcactgttcctccaggcccttgtgcctcttaaaaaaaaatttttttttccactttggaaagctgagacaggagaatagcttgaggccaggagtttgagaccagcctgggcaacataccaaggccctgtctcctcaaaaaataaaaaatgaaaaattagccagatgtggtggtgtgcgcttgtggtccctactactttggaggctggggtgggaggatggcttaagcctgggaggttgaggctacggtgagctatgattgtgccactgcatgccagcctgggtgacagagcaagactcagtctcaagaaaaaagataatcctgtctcagaacaaagagacagataaataaaataaaagaaactttccatggggcttggcgtgctggagtggctctccctggagataggcatgtcctgggagtggcactcacagcaggatatgaacacagcccttggcatcacccacaatgagagatgggggaactcaacagcacttcgattttctccttatttttctaacctttgacagtcacccattactaactgcagctgtgtagagataaagccatgttgtagtcaagtggagacttctcagagggcagtctggaagtaggtgggatgtggccagattacagagggctctgaagtgaggcagaggcttttagacttggtcttttaggtggcaaagagccaacgagccagggaagaagagatcgaaagtttaacatgactggcctggcgtgggttgcaggatgattgagggggaggcaggaagggctcgcatcctaagggacccctgtccttgctgtcacccagcggggttgggggaggacactgttgcccagtgtcttgttatgtgttgtttcctttgttccctctaaaaagttcaaatctataatacacccgtgggcatggagaggcaggcttggccagcacatggggacatgtaagagtcgatgttaaaagtctacatgctgggtacgtaaacagatgagtgtttatgaatatgacgtgaattccaatggtgaggctcagatgggaagctcctctctccgccctcctcggaggccagctcccagcagcacacagagcctcttgacagtcgagggggccaggaaggcaggggattaagggcttgggcttgagtttcagattgacctggcgccgcattccagcactgccctctcacagctgtgtgagctgacaggtatccgaccgtgtaacctcagtttcctcctccaacacggggattccacccgtacttactcagtggtggtggttagtattaaatgaggtcacgcagggaaggctttgctgagctaatctgtgcagagctcttccggcccctggcacgtagtaagtgctcagtaactgttctctactgttaccatcacccacatggctaggagatggcagggcggtggtcggagggtggtatccagtcatgccctcccagcctggcccgtctctaggactctcatgcacagagaattcctatttcctgtgcttagacttcagcctgccttgctcagaactgcagcagctggtgagaatcaaactttactcacctcagaggccccttgctgtgaggatgtgagagccctggggtggtcaggactgcttcctctttctcctcctcctcctcctccggccaatccctgctagttctgcagccctggcttcctcaaaagcaggtcccctaaagaccagggcccagggtcagcactctggtcacatgggctggtaagagacatgtgtggatttccggtggtttgtgaccaccagctctgatgctgcttttcactttcttgacagtacctgaaccagtttgagaactgctgtggtctgcgggaaggtgccatcctcaccttgctgagtgacattggtaaatcccagtcccggaattcaggccgtgtccttcagggagagtgtggtgcccctgtgagtccctgcggagccctgcaggcagacacttcaatcctttggtctctgtggaaggggaatgggagcccagggacgggggaccctggtggagtagggaggtcaacaaggagtcagccagacagatgctgaactcaaataggtttcccttccttcctgattaactcatcaggtgaattatgatgtatagggaataacagatttcctttcccattataaagctcccctccctcctttcctggaatggccggcgctggaataagttgtcattcgaatgagttttgtcccttggcagtgaatttttccgctcccacgtaggcagttctttgccaatgagaggcgtaggaaaaactgtcctttttaatcccttgggtactgttggcttccccaaatgagggcatctgcggcaccctctgagaaggccaagctggccattcatggagaagagtgacctcagcctgcagaggtcagtggagcctcctagaccctggcgctcactcaggaggggtctgagggctgggcgctaaaggtcagcacctggccccagcctggggagacagggagagggacttgctcagagctttttgttttttttaaaaaataatctccagggttgttggtgcaagttgatagttggggtctaaggtttagagttatcagaatttatctttgactctttgcctccagatttggagaatgatgccattttcatccctccactacctcaacctttcaaagctgtatacattttttctttttgtttgctcaagtttttttggaaaattgtcaaatatatagaaaagttaaaagagtagtacagcaaaactcacataccgttcccctcggttcaccagatgttaacattctccctcatttgtaaagctgtcttctctaagccagggcctggaagggttgatggtccaacactgtcttgctagtgtgggtctggtctcttcctgactgctgcttttgacagaggagaagcaagaaggaaaggaaggggaaaagtcaagcaatgacatatttaaggttaagatccaaatagtctgacacagaaaattcccatcttgctctgtgctgtgtcttcgtccctttgggtggagttcacatggaggatacgttgacattacatcagttttatttgactcgaatgagcacccagtgctggcccaagggatcccctgcacatggcccgcatgagtctcttctctgtctacctagagcataatccatcagttagaaattccacttgttttcttgacaccctgacccaaggctcacccatccatgttttgcttggaggcttacttgattgtattttttacctcagtggccagattcttcatttgttctctgttgaattgggttgaaggcaggttagcaggttggggagtattctcttgcttttcttgggtgatttttattttgtttctctttggttaaagctttgtcaagttattattttttttttggatgtttttctctcagatatttttctttcactccttaggctgttgatgactttagcaagtagttattacgaaagtcttttttttttttttttttttgagatgatggcttactctgttgcccaggctggtgttgcagtaggcgacctcagctcactgcaacctctgcctcctgggtccaagcgattctcctccatgagcctcctgagtagctgggattacaggagcacaccaccacacctggctaattgttgtatttttagtagagacagggtttcatcatgttggccaggatggtctcgaactcttgacctcaagtgatctgcccatctcagcttcccaaagtgccgagattacaggcatgagccacagcacctggccaaaagtctttaaattattggcacaagtgccgggcgcagtggctcacgcctgcaatcccagcactttggggggctgatgcgggtggatcacaaggtcaggagttcaagaccagcctgaccgagatgctgaaaccccatctctaccaaaaacacaaaaattagctgggcatggtgacgggcgcctgtaatcccagctactcgggaggctgaggcagaaaactgcttgaacccaggaggcggagaggttgcagtaagccgagattgcaccattgcactcccgcctggtgacagagtgagactccatcttgaaaaaaaaaaaaattattggcacaagtgcacataactctcagcttcctcatatggttgtttattctgcaggtgttttgctgctgatattcacagaacctctctggttacgtattcttttggtctgggtccactttgaattcagttactattgacttgtgtggtagcttttatattattttattcaaattgtgtgcatgtatgtatttaagttacacataaattagaataatgaaaacaggtgcttcttcttaagtgcttgtgtgctataggtctcctatagatagataggtaggtgaatattaaattctgtaggttgctgattctctgtctgtcttctctgtgaccctgagttggaaataatttgactttgaagtactaactagtacactacagttaaacttcttgagggcacaaacttcagtcactgcttatcttcagcatctagaatagcagtatataatcttctctataaatatttgtcaaatgagagctggatgcggtggctcacgcctgtaatcccagcactttgggaggcggaagcggacggatcacctgaggtcaggagtttgagactagcctgactaacatggagaaaccccatctgtactaaaaatactaaattaggccagacgcggtggctcacgcctataatcccagcactttgggaggccgaggtgggcagatcacgaggtccggagttcgaggccagcctggccaacatggtgaaaccccgtctctactaaacgtacaaaaaacccaaaaaactaaaaactaaattagccaggtgtggggcatgcctgtaatcccagctactcggggggctgaggcaggagaatcacttgaacccaggaggcagaggttgcagtgagccaagatcgcaccattgcactccagcctgggcaacaagagtgaaactccatctcaaaaaaaaaaaaaaattgtcaaatgaatcaaataaatcctaaaggaaattaaaataagtaaggacctagtttttttttaaaatcaaatgtccacacatcatgaacagctccaggtccaatactggctcctttgcttattagcagtgtgaccgtgggcacgttacttacacccttttattagcggtaaaatgggagcgttactcaccttgttagaattatggaataaaatgaggtgatataaataaagctcctagcacaatgctctgttcctgcagaatgtgcagtcagcaagtgttagttccttgctcatttccttcccgctctggattttgatttttggcctctccttttggaaaccttcagtgccttctttagggcatgacctgaggctggatccagggaaccacacgggtgggtgccttctgagactcccatcctggaagaggccagccttcctcagacctgttcacatctccgccaccttttgggtgcagtgcagccccggttttgtttttgaggctgctgatgagctcgtattttacttttatccctgtttctgatttgtattctaaatccattaaatttctttttgcaaggatctggtgactgagccggagttcatctaacatagctcttttgtattttggaacatttcctgagcatattttgttccagtttgttccaagtgctggcctcacatttcctttgttggagttgccactgctgttctctgccaggttgacttcagataagtggcagagccacacccttgaccgctgggtccggattcattgccttttcttctggattaaactgttggcccctactctcttctgtgccgctaacctcccagagacacccgctcagaacagtgtcaagataacagacatggataggatttttccactgaatttcaaattgcccaagaagaggctgcagagtgcctgtgagaaatgagcagatggccaggcgcggtggctcatgcctagaatctcagcactgtgggaggctgaggcagatggatcacctgaggtcaaaagtttgagaccagcctggccaacatggtgaaaccccatctctactaaaaatacaaaaattatctgggcgtggtggcgtgtgcctgtagtcccagctactcaggagactgaggcaggagaatcacttgaacccgggaggcagaggttgcagtgagccgagatcgcgccattgcactccagcctggcaacaagagcgagactctgtctcaaaaaaaaaagaaaaaagaatgagcagctgcctggcgggcacagaggtgagccccctgcatcctggccaggactcttctgccagaccatcactccatgctgataggagacctgggacccatgtggagcagctggaaatgatatggactgccacgtaatgtgaccctaaaatagctcaaggaagttatatgtgagtggactctatttaaacagtcttgctcattatcctttggaaaacattggcatgtgttttcttttgtcaagggaggctcaaaattctgggcactcaagattgcagggcaggctgtggtgctctctcctgcctgatggggtgtggctctgctgggcgggcctgggtcttatcagatcttagattggaatcagcctttcctggattctgcaggtggccagtctgctgtggtgacaccatcctgtgctccaggcctttcgggaacccacccctctgttgctgtccctgcttccttctcgagctgctcctagcaggcatccaggacttcagcgttaaagaacagagggtttcagagaaaacatttggctttggggaagagagctccattccaggaactgcacatcaggtgcactgtctagcattgtggatcttctgactggttccattgcatgcatccatctgactgaagtgtggattatagcaaaagatcatttgcacataaagctttttggaaagcataagtaaccaggttaataaatacagtaacaatgagagagaagacagcaggccctcagtcatggctccaccattttatagctctagagccttgggcgaggcatggaatgtcatggccgcagcgtccccttctttaggatgaggggtttggacctccgagtgctctctagggccccgtctccctctaacaactccatttcactgtccagaaatctggttttcaggatggtggccccgggacatctctgacatccgccagctggtggcctaactgcttcccacaggctctgtgtctcatctccactgcctgcccctgcattcgcctgtccgtccttccctccctgcccctgcgctggctgcccgctgctcctcgacgttctgtttccctggccgttcttgtggcctgtttctcaccatattgttcccagaatctggaattcaaccctgaactcatcctaaagtcatatccatgtctgccaggtctttcttccaaagtcaattccagtagaagctctggttgtcttcttcagccaggtccctcctgccatcccctttcttgtgtcatggtgccactttctgcccgctgcccaggaccaagtgtccgtgtcgaacctggtctcacagagtcagcccccgctcctgctcatagccttgcattacggaggctgcagaccgctgcttctgctgattcaatgtcagagcaaatccctgcagcgacctcctccctggcctccttaaccctgtgtgctaacctacccttctgtcttggaagggcacttccatcacagtccactcttagataaaggcccagccccttcgccgtacctttctcccactcagccctgggcatgacccacaggacccacccgccaacctctgtgtgtgacccttggaacccacccgccagcctccaggcgtgaccctcagaacccacccgccaatctctgtgtatgacccacagaacccacctgccagcctctgtgtgtgacccgcagaacccacctgccagcttctgggcatgatcctcggaacccacctgccaacctctgcacgtgacccacagaacctacccgccagcctccgtgcgtgattccaaacccacctgtcccttgctggccttgcacgcgttgccccttgtggaagctgttcttgcacctcccagagaccctgagcctgcccgtcctttgggcacagctgcagacctgcccctctgtggggattgcctggcctggggtcacggggattttcctgtgggtctttctgctgatgtcacctcatttgctcctttgacgcttggcattgccattactgctctgtgatttctgtctgtgccttggcagtgagggctgacttccgggtttggggccagttgaccagactgtgcaggaagttaggaaaaggctttgattcagtggcatgtttcccattgtgtgcagatagtggacactcaatagagcctcgctgagtgaattagtgaagttgtcgcactttcgccttggcacccaacgttactgccttgctgcctcactgattaattgaaggctattttagccaagtaacctttagccagactcagtctctctccccatgtccacagctggccttcaagtctgttttttttgggaagcccagtgacattgaagtggctggcacagtaggacccaggcagtaggttttactgagggaacggacatcctgttgcctttctcactcagtgatgacttggattaccagccagttgacaaccaaccatctttgtacccttctaacctctatctcagccttttggaccatttctctttccacctgttctctatggaatgtagctcaaacaaaaatgttctgaagggaacttagtcatccctctaaacttgtgatagatagagattcatggacccacccttataaaactgctttcttctcggaagtcttgctgctcttatctgttccccagtttgtggtttgtcatctgaaaaaaatacatagggctgtggggctgtgattcggagctgtgattcatcaataagacccacaggattgtcagcgttcttcagttatgtgtttgtgccttcctcatgagccagggaaaggctggggttaccaccggggcacggcttctgaggagggtgagagaaggaggctgttatcttcctatggcaagtctgccatgtggacccattctgtggaaatgtactgtgtcatttatcttagtttttgtgtttttcctgcatacactgcactgtgtcgtttattttagtttttgcatttttctagaggcagggtcttgctctgttgtccgggctagagtgcagtggcacgatcatgtttcaccgcagccttgaattcctgggctcaagtgatcctctcacctcagtctcccacgtagctgggatgaaggcatgcgccaccatgcctggctaattaaaatttttttttttgtagagacagggtcttgctatattgcccaggctggtctcaaactcttggcctcaagggatcctcctccctcggcctccgaaagtgctgggattacaggtgtgagccaccatgcctggcctcactgtgtagttgtgaatagcttaatagtttgcaatgtggtgcttctcacagctcttctctgtaatgggaacatgaaaaattacctggtacagttttatgctttgtggtgtggcttttaatttttataaacatgtcttactgctattgccagggatttagatttttaataaacttccagattcaacagtatttttcttcatctcaatgtctcatttttcatcaaatttaaacaaagttagattctctgggcttgaaacaattttgattcatttcactttagctctgaagtactgttttgtaaaatgtagcacagtgatactgaaccaagctttttgaaagcttattctctgcagggtacatttaagaggacttgcctatcagaatttttacatttcagtcccagaaactatgtgtaacaatacctgttggattctttaaatctggactttattaagttgacagaggtattgaagaatagatgaccaccccgaaatgaggaataaagtttgttttgtacagttgtttaagcataaaaatagacagatattaatagtagtcagagtattcagttaccaacctcttgtccctcctcactgaagatctggtgacaactctaatccacgtggcgtagagagcggtgcctttggtctaatccgaatgctcctcctcttcactggggggttctggggacatctcacctggttgtgccctgggttttgccctgagatgttagcctccagctctgggggccttgtctcagtctgggcatgtgtacttgctcaaattacagtatctcaacttccatatattctgctttggaaaaaactaacctacacttttatgtattacatcctgatactctccagcagtctgtcatataccaaaacaggtcttttgtgaacctatcagttaacagacactttgagttattgcatggccttgctctctgccagccagtagttcatattcaacagcagtgccatccctgtctgcaaggctgtgttagtgcagctattttttatacttcatttaatttattatgctttttcatttgctttgatttttaataaaagtaaaacaaaaataaaagtgctgatgagaagcattggtcttgaaacattaacacaattgagaacaagatgaaatataattttttaggcacatggaaagcagcgagtctttcacctcatctggacattaattggacctaagctgatctactctgtcacttaggaaggaaatgaaaagtaaggaacagtatgatatgttggaaccacatggtcgaaggctggacttaaaagagcagatgcaaggagagatctggcaccacagatagagcatccctaatcccaaagtccaaaatctaaagggctgtaaaatctgaaggtttttgtacactgacatgatgccagaagtggaaaattccacacttaagtacttaacacattgttccatgcacaaaattattaagactattgtataaaattaccatcagactataaaatcatttataaaaattcagttgtttcatataaggtatatatgaaacaaatgaattttgtgtttaagcttgggttcattaggaatatgccagtattccaaaatccaaaaaaaaaaaaactgatcccaagcattttggataagagatactcatcatgtatagcttaatgttctgagctggaactcctttaataaggtggaagtcagttgttcagctctcagtttgactcttaaatatgttttcagcaaatgttcagcttagagtctttgcagagaatgtttgcttactcagtttctgtggaaggcttttccgttaccctgcacagagggccgtacccatgacagcagataggatcgctgcctgggcctcaggggtcttcccctccccggcttgccgagagggagagagagagagagagagagagagagagaatgagagagagagagagagagagagagaatgagagagagagagagaggagagagaatgagagagagaatgagagagaaacagagagaatgagaatggtggtggcggcgacggcatacagagggttcattgttaaacctctgaatgttactgcttttgactttttaagttttaaacaagaaacaggtcataccattaactatccctctgagtcagaaaatatagacccaagagttgcctgttctaatgtggcactaccataatttgttctaacatttcctaatgactgtctgtttctaattatttcattcaagatatgcagtaagtatccttgggctaccagtgaagtgataccatttgtatctcttcttctgtgctttctcaccacttgacattctttgcccatttttctttttctttttctttttttttttaggtagagtcttactctgtcacccaggttggagtgcagtggccatgatctcggctcactgcaacctctgcctcctgggttcaagcaattctcctgcctcagcctcccgagtagctgggattacaggggcatgccaccacacccagctaatttttttgtatttttagtagatacagggtctcaccatgttggccaagctggtcttgaactcctgacctcaggtgattcgcccacgttggcctcccaaagtgttgggattacaggcgtgagccaccgcgcccagccccatttttcttctgcattgctttcttattgatttataagagctttttatctattaggtatctttactctttggtgtatgtgttgtagatattgtttccccacctctcttatcttttggctttgtttatagtatcttttgccataaactttgaaaaccttttaatgttatttgcactgttctatttataccatgtgactttcctgcatacactgctctttttgctacatgtatcccatggtgttttggagtttttgttgctaatgtgaatgggattttttttcctttccactgcaactggatatagctaacatagagaaaagctattgacttgtgtattcttgttcgtttccagacaactggctaaattttatccagtgtttagtctgttgagctctctaggctacatctccaaatctatctccatctctagtcatagcatctccaaataaaaataattttatctcatttcagtactatttatttcatttctttcttttatagtgcagtgaactagatgtctgtcaaagttattcaccctctcttgagggtaaaatcatgtccttcttgccatctgagctgcaggcgggtgcctcctcatgtgacatcatcacgttgcctcctcacagcagaagctcttggtatcaaatgcttccgtagccagtgttgtgcagtctgctttcttccaactagattctgagctctttaaagttggggatcatgccccttattttatgtccctcacagaacctcccagagaactgggcatgtagtaagtctgtgtagggctgtctgtatgtgtgggaggtgtccctgttctcctcttctgcctccccgctgcttcctggaagccagttctgacctcttgggactgtcgatcatatgaccataggactctgtccccaagggcccttcctccttgcccaccctatagaatttagatttttgagcctctagaccaaagaaacttcccttctcaaaactttattggcgtcagcatcacctggagagtttgttaacacagatcgtggggtcatccccagagacttgaatccagaggtctcaggtggagcccgagaatttcacattttgaacaagcttgtttgctgctggtccaggtagtatagtttgagaagcactgctctaggctgcagttggtgacctcatggatgcaaggcaaagagtgctttgcgcaagtaagccagattcctgtggaagtttaagcctcacgtagcagggcccctgccctccaccctgaggtattgcgctacaagtcagagtatgtttcaggggcatgcggcatttatcttttgcaggataggagattctgtcatgaaaagcattttttaggcctaagaaaaactcacccccctcttcctcagcctctgcgcttagataccttcatgaaaacagaatcatccatcgggatctaaagccagaaaacatcgtcctgcagcaaggagaacagagggtaagtgacctcctgggactgggaaagcctcaggtgggcgtgccgggaagtggcctgggaggaaaggagcacactctgcatatttgtgtgtatttgcatttccttgcctgtgctttgattctctgggaatgctgtttgatttgaaacaaaattgagcaaaaaagttgttgcagattgaggcaagtttaaatggattacattgttagttgctcaagttgcaggaatctgataaggaaaataatgtttgccttcctacctccacccctagcctctgggactagcgcttcttggaagtcgactttttgttttccatttgctttaagagcctcgcctctcgactctaaatggaaaccagtggtcagttggttgtggatgtggctgggaagaggcactgggagctggcctctgctgccaagcctggtccagcctatagtttccccagagctctttgtggcctcctcagtggccacccggctcagacgtggtgttgactgccccacaagcttgacattgtggtctttacccacccactctatgtgttcagctggggtggtgagcacaggctcagctgagtggaatacagtgaatgagttcttagatcacctaatcccttcccatacagctgcccttagcacctaggcctggcctgtgactaccacagggctcgcccttgttccagttcaccctcactcctgtcagtggtgctcagatttgagaactgagggcatttactgagaagaggctggcccggtccttcctgtttcaagtctgggtttagctgtcttgagggctggtgcctgttctgttcattcagcttccctctgatgatgcgtggcagagtgtgggaggacacgtgcctagcatttttacaatatgccttttcttttagccctgaatctaccgtgtcgagggcattcttttgtgtatctggtggctcttaggagtttgggatctaatagtacctgggaattcagaaatacctctgctctaacaccaggcagtcagaatcctcgtagaaggacattgtgttcttataaccctcagctttctccttccttttgttttagttaatacacaaaattattgacctaggatatgccaaggagctggatcagggcagtctttgcacatcattcgtggggaccctgcagtacctggtaagaagtgggccttgcctgtttgcctgtcagctcctccctgctgctgcatttgtggggctcctgtcctgccttgctcccagcacctgagtcccaccggctctctgaatgttttggagatgcatgaggtcacacccataacctggtcgagtcagcattttttgccaccagatgccctgtggagggatgtggtcgtcttctctgatgtccggagggctctgctcatgcgccttgcaccatcccctagcctctctgtgcttcagtgtcttctctgaaaggaaagggttttaaacagatccatgctggtcttgagcggtcctcccacctcagcctcctgagcagctaggactacaggcaggagccactgagcctggccgaggccacactttccatgaggtatttcaggggccactgagtaggggtcagagctctgagctccccaccctttgtttacgttatttggtctgaatattaggtttctgtttgagtcactcattcattcaagcatattgatggagtgtagtctgtgtcaggcactgtgctcagggctggtgatgcagtggggaaaaaagacaagcccttttcggccttcagagcttagggtttagcaggaaagcaagcattactgtgatgcttacacagataactaagaaattacagttgtggtgagtgttacaaagcaagagtgcagggtgttgcaagaatatatattgggtggcctcagcctggtctgggacttgaagggtaaggaggtgaaaagggctggaggtgggggacggcagggggaattccgtgcaaagggatcacacacaggaagacctgcaggtgtggctggaaccgagcacaaaagggaaagagagtcttgagttgaagctgagaacaaggtagagcacagattatgaagggccttcagggctgggctaaagttctagactttatcttaaaacctctgcagagattgatgggttttaagtgggagaaggagcaactctttggaaagcccactcctgacactgtgtggagaaggaatcacactgaacaggagggaaaagtgggtgaggtaggggcagtgaagatgtagagggcaattagattccaggagggcttagcacaaatgcccagcaagacttgtcataggttgcttgatgatggcagtagccaccacaattgggagtgactcaaggagtctgcggctttcagagtgggtctcacagagggctgtgattcaggcgcctgtgtccatatggcatgtgatttggtagatccttctggagtcctcctcagctcagcagcagtcgagcaagggggaccccatgctctaaccaggagctgagtcaagtcatgtactcacatgagctaaaacttctgcccataaccagacatagaggttgacctacccatcccggaatgtcttctcttggtttggtctcccgggcccttccttaagcttcacatttccaaccagaccatgcaccaccctgtctctgtgcttttgcttgccccagtcatttctgtctccacccacctgctaagcccagtctgcacccccagcaccccgtgctgccgccccttcttcggtcaccccagcgctctctgcctcagcagcagccatgcatcacactttccctgcctgtttctaaatatcctggccctttctgcaaccacatggtacctggttcaggggttcaaccagcacttaatgcgtgtatttggtgtggacagcctggcatcattttcctttaacatttgtagcctctcttcccatttctacacagtgcccacgactgtgtcctgccttaagctagttttcaataagcgcctgaaatgctgcaaccctttttttttttttccttttttttctttctttctttcttttttttttttagacagagtctcactctgttgcccaggctggagtgcagtggcatgatcttggctcactgcaacctccacttcccaggttcaagcgattcttgtgcctcagcctcctgaatagctgggactaaaggtgcacaccaccatgcccagctaatttttgtatttttagtagagacggggtttcaccatgttggccaggctggtctcaaactcctgacctcaagtaatgcgcctacctcggcctcccaaagtgctgggattacacgtgtgagccactgcgtccagcctgcaaccctcagttttaaaggagagaagttaaagcctagcgatgggtgtgtgatgtactctggccctgaatctttagcccctccatcagtacctactggagtgagtgggacatagaaaggtcttagaaatggtagcatgatatacccgctaaacatgcctggggtgccctcctcgccctgcatgcatgtgccagtgccctctaggatgaagccaggggtgaaagcagatgggctggccgccccctcctgccgtggtccccccagagaggagcagctcaggtgtaccccctcctgttgctgcaggccccagagctactggagcagcagaagtacacagtgaccgtcgactactggagcttcggcaccctggcctttgagtgcatcacgggcttccggcccttcctccccaactggcagcccgtgcagtggtgagtgggcccggggcacctggatggaggagggagcctgtctgttcctttctcttcacgtaccctgtttccctggcgccccatcaccgggcctgggagatctgtgttgtttctcttccgagaggaaggcctgtcaggacctagcacgagtaggggagtggtctgtgctccaaggacctgttaatagatagagtagctgttaagtcttcatgtggattctgagccttcacatctttaaatacaatgctgtgtcagtgtcatctgctctgtgttcagaagtaagactattgtatgaatatacgcacttacactgagaatgctgtgtgttagtaaacaaataaaacacgtgtacacatgacaagtcaggaggaaatatgtgaaaatttgttgttgacaaatgttactacaacctgaatataaatttttgtttttaaagcgtaagaatgtggccgggtacagtggctcactcctgtaatcccagcactttgggaggccgaggcaggtggatcagttgaggccagcagttccagaccagcctggccaacatggcaaaaccctgtctctactaaaaaccctagccaggtgtggtggcgggcgcctgtaatcccagctactcggaaggctgaggtgggagaattgcttaaacccaggaggcagaggtcgcatcactgcaatccagcctgggcgacagagtgagactctgtctcaaaacaaaaaaagtttaaaaaaaaaaaaaacaacagctgagcataaagcataagaatgtagctgaaattgtgaacctaataaattacacaaaaatttttccagtaaaaattaaaggatatgatgaagatttgtagaattaccctgtattctttagcttttgttttactgattaaagaaataatgcattgtgcaggatatgtttatataaaagttaattatcaccaccaaaaatggtatgtgaggtaatgtatatggtaattagctcaatgtagccatcccacaatgtgtacatcatgttgtacaggataaatatagaccatttttatttgtcagtttaaatcaagaactgggggcagaaaagaaataaaagttaattattactgaaagccataatttaaaaatgaatattcccccaaatcagttagatttcatttaggattgttccttgagaggccacacactagtttaaatgatgctactctgctcaaaatttacttacttcaagttttattttttttggaaccgtaataagttcatgtggctcaaatttccagaagaataagggagtatgcagtgaagtcataccagcctcccaggccctcatttacctccccacaggcacctgctgtcttccaagaatgttttcatatcttccaaggtgttcgtatcttccaggggtgtttgctacgtgttccagtaaattggcatatatttgtttatttgtacattgatgtttcccctcttttttatcccaatggtagcattatctgaacacggtcctgcacatgctttcaagcttttcacaccatgagaatttctttttgagccaatttatctgcaacacaaaaaattattattttgaacttaaatagtactgcatagtttaattaccccctcatttttgccagattaactttgtttcatttttgtgttttggaaaatatggaaacagtaaaaaagcaggaatcaactgtcatcccataattggaaaacaatcactatgaacagttgtgtgtctccaggctcttcagcgttatatttttgtactttttaaacaaaaataggttactataatcttcatacaacgtgcctttcaaactagatatcaaaaatgctgtatgtttttccttattatttgtaatgtctgttatttcactgaatggctgtgctgtggttcatttaacttatcccccgtggttggaaggacgttgataatttttacttcttaaaataacaccaagaataacatccttgtagggaaattcttgcacacagttgtttccctaggataatacctagaaagggaaataacagattaaagagtttgcacgttgtaaaggtttttgatgcatattagttagcaaactgctcaccaggaaggtcatataaatacacgtctccacctggagtgtggacactgcccctttcaccacatccttgccaacactggctattgtcaccttctggaagtaatgaaaacaaaacatgaatgttttcagaggacaagtgtctacatcttgagagtatttgtttataagaataaagtgggccaggcgtggtggctcatgcctgtaatcccagcagtttgggaggccaagatgggcggatcacctgaggtcgagtttgaggccagcctggccaacatgatgaaaccccatctctgctaaaaatacaaaaattagctgggcatggtggcacacgcctgtaatcccagctacttgggaggctgaaacaggagaatcgctggaacccaggaggcagaggttgtggtgagccaagattgcgctgttgcacttcagtctgggcaacagagcaagactccatcttaccaaaaaaaaaaaaaaagaaaaaagaaaagaaaaaaagaataaagtgtatcctttgaaatcaattccagaaaagtggtcttaggtgatggcagtctgttcaattccacgtttacctcccagtgagggaggtgtctgccctgagttttgagaagtggcaaagtatgccccactatggtgacttattttaaaacaggcattgctcctttagctacataggttctggaatattgaggaatttgttcattaatttatagtcacactttatagtatacgcattataaaaatagctttaaattgcatgtacatctatagtgggtttttttgtttttgtttttgttttttgagacagaatctcgcttttttgcccaggctggagtgtagtggcgcgatcgcggctcactgcaagctccgcctcccgggttcatgccattctcctgcctcagcctcccgagtagctgggactacaggcgcccgccaccacgcctggctaattttttgtatttttagtagagatggggtttcaccgtgttagccaggatggtctcgatctcctgacctcgtgaactgcccgcctcggcctcccaaagtgctgggattacaggcgtgagccaccgcgcccggctgtagtggttttaactaaaggaattattgcatttcttcaggtcacttgttgagcatgtctcttatttatgacaagatgagttaaaatccattagaactagaagaacaggtgctttttgaaaatacattcctaatggcccagcgtcttcataggaaatctgttgtctgcagagccatcttcctagagcttccctcatcagtgctggaggaccaggtggccagtttcaagtagatttctctgaaacccaataaggagctgttttgtggactatctagtttttaatgctttgggaaacttttaaaaaatttcactatcttatctcagatggcaggtaaatagtaatttccagacaaatgcaatttgggctttacaattctattataaagccactttgaaatatattttaggacaagcccaagcaataagcatcttattttgggtccttttctaatttcccatcaacagcctaagttttctagcagaggcttattccacacttacataattagaaagtcttggagcccccgacttagagctgtcagagtttcagcccaagctataaagcaccagcctctgccacgcaccggctcttctagctttccagtgccagtgtgctcccgataggccggttcaccacttgccaatgagaattgtttggagcaaagcattttttatttgaatttcctagatgttttgaggaaaaaccgtagttggacattcagacagaatagaaagaacaccagacattgggtttgagcccctgattctgctactctgttgtgtgaccttggacaaatcatttgatcatcatttcctttagtccaaattgggggactaaaaataatgtctgccacatgggcctgtcacggcaataagtgaataaatgatctgtgtcagagtacttggttatctatgaagtattattcaaatttactcttcttattaccaagatttgaagccatttgtatgtagattatttttactggccgggcactgtggcttacccctataatcctagcactctgtgaggccaaagtgagcgaattgcttgagtccaggagtttcagactagcctaggcaacatggtaaaaccccgtctctacaaaaaatacaaaaatttgctgggtgtggtggcgcacaccagtagtcccagctactcaggaggctgaggagggaggattgcttgagcctacaaggtcgaggctgcagtaagttatgattgtgccactgcattccagcctgggcgacagaaaaaaaaaatttttttaccttcagatactacttcacataccccaagaagttccctaagttgggaaatgtataagttcatttatccttagtatttagctgtgtacatttagagggaagtatctatgtgtgtgcgtaggttttgcatattttatgtaaatgtcgtatgcatgctgtaatctaggtttggaagtcctaattttaacctctgtcaaaacacaagagtgtgtaatagatgaaatagaaggtagagcaagggagaaggaaaagccaaggatgagataaggaggcagtggtactatctgcagaactctgggcacaagatggtcagtgactctgctaaaggttgctcttcaaaaactcatccaggcagtcctgaccagtcttaaactctcaaagaatctgcctgactcgatgtgaatgaactgactgctattccaaaagactggggctataagtctcctgtatagttgtaaacttatattacaaatgtaaaatggctcttgagtgctaagtgtcgtagggatatgtatgactgtatatttcattgacatcccagtcaacaattgactgcatagatgacagtggtctcatgagattataatactgtatttttactgtaccttttctgggtttagatatgtttagatacaccaatacttaccattgtgttaccctggcctacagtattcagtaccggagcatgctgtacaggtttgtagcctaggagcaatagggtgtacgatacagcctaggtctgtagtaggctaaaccatctaggtttgtgttatgttcacacaaggactaaaatcacctaatgacgaatttcttagaatgtgtccccgtcatagcaacgtgtgactgcacctaacaagattcatatttgcaggcattcaaaagtgcggcagaagagtgaggtggacattgttgttagcgaagacttgaatggaacggtgaagttttcaagctctttaccctaccccaataatcttaacaggtaaggcacagcggcattacacgaatacatatctttcttgctttttttagaaatacaagtcttggctggccgtggtggctcacacctgtaatcctaacagtttgggaggctgaggcaggtggatcacctgaggtcaggagttcaagaccagcctggccaacatggtgaaaccccgtctctactaaaaatgcaaaaattagccaggagtggtagcacgcacctgtaatcccagctactcaggaggctaaggcaggagaatcacttgaacccgggaggcaaaggttgcagtgagctgagatcgtgccactgtactgcagcctgggagacagagtgagactccatctcaaaaaaaaaaaaaaagaaaaaagaaattcaagtctgaagtgacatctgataacttttaaacaggctatcaggatatcgtcctgtgactaagaaattaacatagtccttcttaatcttaaatctggaatgggttttcctcccttatctccctagaaatcatctcttttctaagttcacataacaatttatctatacctcttattacccttaatagcctctaccttgtatcacattcggttttgcatagggtttatctctgattcaacagcagtccttttaagggtagggaattataccttatttctctttccacccctcatgtggcccaattctgtgtcacagtcaacaaataaatctttgtcatttgaatggcattacaatccagtctcagagccagaatctaaacaattaataatattgtataattgtacagaattgggtaacagtgcaaaagaaagctacaaggcagtcacacataattgagtgacatggataatgattaccatatttagagggtggaagagatgattggatggattagtgctatatggaatgacgtgggataagctagaactttttggaagggtctagacagatgtacaggacatggatagatgaagagaaaggaggaaggaaattctaaggggaaagattgaggtgagcaaggcacgtttgggaggtggtgagtagctgtgttggcctcagggaagggtttgagtgctcacaggaggcaggctctgcagggccaggggaaggagtttggagtttgtcatgtgaaccgctatatctggcagcatgggatctagattctgtaggggtcacctaagctaggatgtgcctataaagtgtatttttaaaacctcatgggttattctttttccccttctttcttcctttctttttaagacagagtctccctcttgtcacccaggctagagtgcagtgtggcacagtcttggctcactgcaatctctgcctcccaagttcaagggattctcccgtctcagcctcccgagtagctgggattacaggtgtgcatcaccacgcctggctaatttttgtgtttttagtagagatggggtttcaccatgttggccaggctggtctcaaactcctgacctcaagtgatccacctgctttggcctccccaaagtgtgggattacaggcatgagccactgtgcccggctctcatgggtcattcttatgcagccatttggaggtcagcaatctctgatttgggggtattttagaattcaggagagaggtgtgaacacctgaataattgattggaaatgtttatactgtttctgataaacccattttcattttcaatcaccgtctactggctgccgtctgtgtgtatactgggagacgcacactgtagcccaacattggctggaagtgtctcctcacacactatgctcctctccacagtgtcctggctgagcgactggagaagtggctgcaactgatgctgatgtggcacccccgacagaggggcacggatcccacgtatgggcccaatggctgcttcaaggccctggatgacatcttaaacttaaaggtgagtgtggagccaagttagccctgaggcaaaagctggggtccccagtggaacatgcagttcttaggacagagcaggggatggggccagctgacctagtgaggaaatttaggctcctgcatcagtctttctgcataagtaaagaaaggacagttgtgctaattgacattggctatgaggtcatagccacagacaggattatgaaagatgcaaatatgcgaaacatggcacatgacctccctccctcaagctaggcccttgctttgtgtggttgggaaatgttgggagtagcagagagaggacctaggcaaatagatgggcatttccttgaagaaatcggttttccagtaacatctgggttgtgttgcagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaaggtgagccctggcttcgtacacaccatcctgtttaccttggctgtgcctcctgggaaactcaacacactttcagatttcaattctgctttgtcatgtagtctgttaatcacacagtgcggatacctggctggtttttaagttggagtatggtgtcctctgtgtggcctgataggaaacacaaatctccttgctggacttgttacttccaaaccctccaagaccggtctcttgcctttattgcaaaaaatgatgctataacactcgaatctctcaagttgcctgcttggccctcttccaagtgtactaaaaaaaaaaaaaaaaaggatgctgcactttcttgagtcaactgaaagtatttatgatggcctctgtgtacagaactgggttaggcacctgtgttaactatagctgtgtaagacatgacctctgctcaaaaagaccttctcagctgacttgtggagctaaagttatcatatgagaaataatcattgcatagggaagtatatagtgaatttctgaacttcccagggaagacagagagtaaaatagaatgtaatacgtttgtaaataaagagtgtgttcagacagtaagtgtggctggaaacgttaaacacttcatggatgcttcctacttgctggctgaagatgatgctcttgctgaacagtggggaaagctgtggaacttcttcattatcagttagaaaagagagggttggatccacaagattcattttgtccttgtccctttgcagttaaatgagggccacacattggacatggatcttgtttttctctttgacaacagtaaaatcacctatgagactcagatctccccacggccccaacctgaaagtgtcagctgtatccgtaagaatttgttatgttttgtttttctaaataatccgttataatatgtgggacaaggcagggaagggagactggactaaggaagggggagccacgtaaaggaaattaatatcgccagtcctcagggcagccttccttatttaggacatgcaaggagtagccaggcaagagagagtacaggaaaccattagttaatttcaacctcctaggacgggcgtggtggctcacacctgtaatcccagcactttgggaggctgaggcaggaggatcacttgagcccaggagttcaagaccagcctgggtaatatagtaagctcgcaagtctactaaaaatttagaaattagccagatgtggtggtgcatgcctgtagtccagctattcaggaggctgaggcagaaggatcacttgagcctgagagttcaaggctgcagtgagtcatgatcacccccactgcatgccagcctgggtgacaagagcgagaccttgtctcaaaaaaaaaaaaaaaattctgttgaaaatatatggccctatatacatatgtgtccaatggttcgtaaagtgttccttcaaatcaacagctacttattgaccactggtacatgctgttggtacaaatacatgtatgtgacagtaaccaggcataacaccctccaaagttacatgatcctatagtaggtacaaaacgtgaaagtgccagtagtgtcgaaggcaggatatggttaattgtaggagagttattgtggttattctttgacaattgcttgtgtctctgtctccagttcaagagcccaagaggaatctcgccttcttccagctgaggaaggtgtggggccaggtctggcacagcatccagaccctgaaggaagattgcaaccggctgcagcagggacagcgagccgccatgtagcgtgccaggctttttttttaaacttaatttatttaaaattccttggtggctttggccacagggaggtggttgaggcagggacccagaagcaaccgttatgagcaacaaaaggaagacactggtttggatggacgggaagcggttgggtgggctggactgacggaggcccctttagacctggcgaggtgagtgtggttggcacagggtgaggagtgtggaactgaagctgggctggccaagctgtggctggtttgggaacccagaggagctcactaccatgtggattagcaaaactcccctgaccgtgctgctggggacttacggactctttcctcattgtgactcgtttgccaacattattggccttttgtgtcttcctttgcctgatgtcaagtttagtgcagaacctcaggcattgctgagggctaggaaattgtccttgggttataagtggctgctataataatagtgatgatgataataattatagcagggacctcccttgacatttgagggggttttgttattgtacaggaaatggaatttggatcccagagatgctccaagactgttccttgtggtccctgcaggatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagtgagtgtgcactttgcaatgagtttaaagacaccatttttttttctttttctctttctaaggtttcttttgtcctattataattgagttgcttatttctgtttcagttttgtggtgtttttattttgttttgttttgtttttccttctcaattttttttcagcatcagataaactgctgctggcctggagggaaatggagcaggctgtggagctctgtgggcgggtaggagactcattttgggtttcggaacttaccaagggggtgagattttgtgctcccacttttcactttctcatcaaacactgggtcgatctctgtcaaaaatcaggtgttcctcaccatgctttgagcttaactggaccagctgaaaagaggccaagagagtagccagtgaagggagcccctctgtggccagatgcaagagctgcatgaatggacagagatggtccaggtttaaataagaagcaagggttaggttcccttggggaaaagccaagaccatttcctgttaggaagggcattggattgatgatcaacactccctcttgtcgaaggtttttgactaattttgttgggatgctaaatccataggaaataaaaggtctaggcagaaagtctcagggcagcgtaaatcagatgtcaccaaaaaaagttaattatgaaggcaaaggaaatacatgtgacttaatgaacctcacacaaactgaaggttgaagtcaggctccggggctttttcctggacttatcctctgttttcccctgtgtacttgggcaaggatcttcacctgtgtcttagtatcgatttttatgaatcagtactgatggagtatatgtgtgtttaatggtgaatattaaccatagaagggctgagtgctcctccccatcttgggactcataatctgtgaaataaaacagtctgggcctccctgcccgggtagcatcaggatagacagatgaagagaagagaaagtaatgtgtcttgggcatcttctgtatgccaggcaccatgccagaggctttaagtacttcatcttacttgactcctcagatggccctgttagaagcctattttatgcaaaaggaaactgtagctgggggtaagtaacttgccaaggggtcacacagctagaaagcggtggaccctagatgcaggcgcagccattcagaccccacagtccacattcctttgagccagtccattgagggtcctcagggaatgtggcgggtcccctggtctcgctcccccgcagatcttgcatctcagcatgcgcctaccacatcagttgacattagcacagcttttccattaggagaacgaagtgaaactcctggtagaacggatgatggctctgcagaccgacattgtggacttacagaggagccccatgggccggaagcaggggggaacgctggacgacctgtgagtactggctggggggcccctctgtgcccagcacacacagacagccctggagcttcggtgtgtgtgtcaagggcaccctcagtggctgtgcgggaccattctctagagcatgcttccctgtggggtcacttccagcaaatcatcactgagcttcagtttccaaatctgttcagtgacaagaaaaacagtcttaagtcacgaagttgtaaggatgaattcagataatgcatttgagacgcaggccataatctgtaaaggctgtaaaatgcaagcagcctctacccctgtagcagactcccctgatttgttccacccaccctgactcaggcatagctcagagcagaaagtaaaacagagaaggaagaacctgatgaggcttaggagtttggacctggaaactattcgtttgagtctttgtcaggtatttggcattggctccatgaggggcggaggggtctaggcagatcactcctacctgaaggagatcacatgtgctcctggcgtacagatggagggaaccaggcaggccgcttgagggctgtgtcaccgtgagctcagcagtgttccctgattctctcactaggattcttaggacaggagctccaaatgtcagaactttgattctgtattttctctaattaaccctttattctcctctagttcttttatttgtatttgtattatttttttaagagacagggtcttgccctgttgccaatgctggagtgcagtggcacaatcatagctcactgcagcctcgacctcccaggcttatgcagtcctcccatctcagcctcccaagtaaccgggactacaggcgcatgccaccatgctcagctaatttaaaaaaaaaatgtttttggctgggcacagtggatcacatctgtaatcccagcaccttgggatgccaaggcaagaagattgcttgtgagcccagaagttcgagaccagcctgggcaacatggtgaaactctacctctaccaaaaaaatgtaaaaattagccatatttgacctcaagtctagacagaacttctttgtatattttagagaggagcaagcaagggagctgtacaggagactaagggaaaaacctcgaggtaagtggggttctgtgtctgccttgggcttctccttatctcatttatggggcatcactactctctgctggcttccttgaggaactatgctaccctccctctctccagaccagcgaactgagggtgacagtcaggaaatggtacggctgctgcttcaggcaattcagagcttcgagaagaaagtgcgagtgatctatacgcagctcaggtatgagccccgaccttcctgctctggaggaaggactgggagatgcaggtatgaggtcaccttcctccctcctctctgattcgctggacctcatgaagagagtttctgcagctgctgactggatgcacagctgccacaggttctgctttctccagcccaaatgccattagtttgccatgtttattctttgcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtgtgagtgagtgctgtggtcccgggcccttggcctagcagcctcctgtgcctttccacctctgtgcactgccgccatcccacacgggacaccacagagccaccagcagcccactcagctgctgctcgggcttcacgtcgctgttctttgacttggtgtaagcggggaggtcagaggaagggcctgtgctaattgttttcattcatctgtgtattactttcgtgtggctactgtaaagattagcacaaactgaggggctaaaacaacagaaatttgggctaggcatggtgactcatgcctgtaacgccagcaatttggggaggctgaggtgggaggattgcttgagcccaggagttcaagactgcagtgagctgtgatcatgccactgcactccaacctgggcagcagagctgtctctactaaaaacaaaaacaaacgtgttatctgagctctagagcccaggagttgaaagtcccgtgtcagcagggctgagctccctctgagggctcttggggagggactgtccttgcttcttccagctcctggtggttccaggcgttctttggtgtgtgactccagtctctgtctctgtcttcatgggacccctgtgtcccttatctgggtgactcttacaagaacacttgtcattggatttgagtcccacccaagtagtccagggtgatgtcatctcaggttctctaaagacgctttctccaagtacggtcacactcacaggctccaggagttgggatgtgggcatatccttcttagggccaccaattcagcccaccgtcatgcacggcagtgcaacttggttgaccatcgtctgcgtctgcactgccctcagtgcagtaagccacgctttctgtgcacaccgtcttaacgtagctgtgagtccatgggatgccacatggtggggaaatgggaaacaaaacagccaagaactgagacgggcaggcctggccgtgttgtgggagccagagctgttgggactgcaagccccattgtgaaaggctgcagagaaggtgacatggatgaaagagtgatttaggtgtcagtttcccttaagagcaaagggaaggagagagggagatggttgctcatggtggaagcaggagatggtgcattaggagattctcattgtcaaaggcagaggggacaatccacacacagtgcagagaacagaggggctggggtcgcatgccagagcactgagcatgccttgggagcgtgattgacacatcctcctgtaagaagagaggaacgggagaaaacaggatgacgaggtagagaggatctgaagaggagagggaggtgcaggtatgcgcaggtgatagcctgatgtgccatctacatccattgagcatttactgaatgctaactatatgcccagcaagacacacaggtgagaaggcatggcacctgttcccaggagggcctgatccttcaaggggcacagacagaggcatgagtgagagccgttcagggcaggaagggctaggaagcagctccaggaggcatgagctgcagtttctgtgcacagggggagctccagcttgtcttagaggagagggagcaacaagaaggttcacaaggagctgttccagctgaagagtgaggatgttccaggacagagacactgctttatcaaaggcagagagcctggggagtcagtgtgttctgagtggggacaggctggtgtgtgtggggaaggccacaatggaggatgaagctgctgaggtaggcaagggtgagcttacgtgggccacgcttcattttctttttttttcgagacaaagtctcgctctgtcccttaggctgaagtgcagctgctcaatctcagttcactgcaacctccacctcccgggttcaagtgattctcctgcctcagcctcccaagtagctgggactataggctcatgcccccacacctggctaatttttgtatttttagtggagatggggtttcaccatgttggccaggctggtctcgaactggcctcaagagatctaccccccttggcctcccaaagtgctgggattacaggcatgagccaccgcgcctggcctatgtccattttcaaagcacacaggacacatggcagtatctgtcttttcccttgatattaaaggaacttgagtgtagggatatgatcacatctgggatttggggaagtccctctccaggcagctggaggatctgagtccctggccaacctcagcactgagaagggccgctcagcaaggctggagttgagccgccgctgtgcagcacagaacagggtggggcaggagctggggcagggcctggctgggagggagccaggcagtgcaggagccatcccctgccatactttcggtccagggcagaagcacaggaggccaatgccgggcctctccccaggcatggtcagcagggaaggtgcagcaggaggaccaggaacgggaggcttgggtgcttaacatggcttcttgatgtgtgggccttgaggtttcgctggaggggaggatgtggagccaggatggttccacggcctgagggacacgtgaggggatgaaggactgcaggccgaagtgagtgtcaggtgtggggcctggggggctacatgggtgggttggggaccatgcagggcagagatcagcagaggggtgacctgaagattggccggcggtcgtgggctgtgagctgaggaggctcaggtagctggaatgggaacccctgcttgacccttcgggctgggaggggcagtggctgcagccccttgggagtcagggtgtccttgtttcttctcagccaggtcatagaggatgcaagccacaggaattcccatagcctttgtgtgtgtgtctgtcttctacctggaaaacagtaagaatactttcctgttcttttcttgtaaaagttcattaaggggctggatgcagtggatcatgaatcccagaactttgggaggctgaggcagatcacctgaggtcaggagttcgagaccagcctggccaatatggtgaaacaccgtctctactaaaaatacaaaaattagctgggtgtagtggcacacacctgtaatcccagctacttgggaagctgaggcaggagaatcgcttaaaccccggaggtggaggttgcagtgagccaagatcgcacatcgcacttcagcccaggcgacagagcaagactctcaatcataatcaatcagtaaagctgatgaaaataaaaaagcctgcaaattaatgtaggcacccaggtctccttaaatttagaatcctttcctcaaaagtctccgttgatacagaaacacttttgaagccagatgtgaagcaccagttgacccgcaggtgggggtgccaactggtaggctgtagggttagctctggcctctggcagccagccagttgtctcctaagaaaatactgtggcgtgaatgcaaaatgtgattcatcacttggctcctaatttcttttgattttgtcccctagagcaaggtccgtggtcctgtcagtggaagcccggatagcatgaatgcctctcgacttagccagcctgggcagctgatgtctcagccctccacggcctccaacagcttacctgagccagccaagaagaggtaggtcctccttagcagtgccaagtgtgaccatcaagggcacgtcaggagatcggggatggaggcgtttgtcactggtaaatgtctgtctgatggtattaccacctctctggatgtttgttgcatctgctgggtcctgtggggacaaaagtgatacatgtttggctctcatagtcccttgaaacttactaactagtttctttgtccaaggcttggatgactaactgcttaatgagaacattggaaatgctggtcaggcacatgctgttaccctttatccataggaagccacattcccttcagggaggccctgaagccctctgcccccactcaccctaccagtaccttgagttaccgagtcaccaccctcctcccggtgccactgaccttcccattcttcccgtcctctccctcctcttgcctgaaccatcgcagcagaggtgggggcagggctttctgcctcctgcctcctgcctttctgctgccaggccctgtgtggttgaattaatcttcacgaaataccactctgaccaaggtgttccttagtcagtcataaataacagcttctccctccattatagatgctcaggtctgagctttcgtcaagtctcatctgggccagcagtgcatcatcaaattctcaggtcctgctggagacctcacttgagagctcagggttggggcccagcagtctgtgtctagcagccctccgcccgttctccagcacactgcaggccacttctgctcccacgcccatctcttcctgtgttttgttttgtttgacaccttctgtgtgcagggctctatgggttcctgcaggctaatctctaggcatgggaaacaccgatgattacctggggcaggggaggaggttgggagtgactgataattcaaggtttcttctgaggatgacgaaaacattctgaaactagatatggtgatggttgcacagctctgtaaatacgcgaaaacccttgaattgtacactttaaatgggtgagctttatggtatataaattatatctcaatacagtctgctttgaagaatcttgttcttgtccttgggagtttgtagcctcttttggtgtttatgtgaccttggatacttaattttctcttggctgtatggcacgcgcttgtaatcctagcactttgggaggccaaggcaggaggttcgcaggagttcgaggcaagtctcctgggcaacatggtgagactgtctctctctctctctttttttttttttttttttttgagacagactcttgctctgttgcccaggctggagtgcagtggcgcgatcttggctcactgcaacctccacctctcaggttcaagtgattcttctgcctcagcctcccgagtagctgggactacaggtgcatgccaccacaaccggctgattttttgtagttttagtagagatggggtttcaccgtattagccaggatggtctcaatctcctgaccttgtgatccacctgcctcagcctcccaaagtgctgggattacaggcatgagccactgcacccagcctttttttttttttttttgaaatggagtttcgctcttgttgcctaggctggagtgctatggcacgatctcagctcacctcaaactcagcctcctgggttcaagcgattctcctgcctcagccttccgagtagctgggattacaggcatgagccaccaggcctggctaattttgtatttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaattttgtatttttattagagacagggtttctccagcctgttggtcaggctgatctcgaactcccgaccttgggtgatccgcccgccttggtctcccaaagtgctgggattacaggcgtgagccaccgcacccggccctttttttttttttttttttttaaataaaaattatttccccaacctctcatgagctcctggagtatagtagctagaccgggagcctgttccattcccttctggggcaggcactgagcctttaggctagctagaggccccatagatgaggcttggcagaaatgtgctctgagctcctgccatcagattgtcacattttgcagagtgagaggagttccagggcagtcttcctttatgtggcttattcccttcagtgatgtcctcaaaggtctagaaaggtggacctgggtatataggatgtctctcgtctccccacagcatagagctgaggttagaaaaagacggatgttttactacatgctgctctttttcactgtggcccagtcctcagaggaaacatgggtttcttattatagaaaagagagagatcagattagatgaaaccaaatcccagaacttgattttcaacagattccaaggaactgtgaatcctgataaattccttggccttttttttgtctacttcaaaaattggaaaacaggtgatttggagaatatctttagattttggcagtttgaaaattaaattcagctatctagtaagtcagaaagcagaaagaggtttttttgcttctgacttttattgagatctgtttgcttttttgcattttggacagtaacgctcatatgtggaaagtgcataacaagatgaatgaaagtattagtcagtgggttggtgttttaagacactcaggatcaaaataattgttacttcatttaaaaagtattatcaaaactctctagcatattttaaaatagcagtgttagctctgataactaataatgaccactttctaataatttgatcattttctttagtgaagaactggtggctgaagcacataacctctgcaccctgctagaaaatgccatacaggacactgtgagggaacaagaccagagtttcacggtaacagcttgtgtgagactcctgcgattccatgtcctttctttctatggcaaaatagaagagaaaatggaaatgcaatctggcattatcctcaacctcagtgtttgtttgtttgcttgtttatttgtgacagggtctctctctctcacccaggctggagtgcagtggcatgatcttggctcactgcaacctccgcttcccgggttcaagtgattctcatgcctcagcctcctgagtagctgggactacaggcgtgcgtcaccacattcagctgattttttcagtgtatatttataattttctagtacacattttttattattcataataatagtgatgtctaacaattattgaaggcttacaactacatgtatgcattatcttatttaatccttggaacacttaattccgatgatgaggaagaaggtagcattgttcccagaagcctgtccccacctgcaccattggtactactgctgagtatttgtgtgttgagtgctgggctgggagcaggaaccagccatggccttgtcctcagggccttggagcttagtggtaggtagtactagttatgagaaaactagccaagttacaggtacattaagacaaagcttccattgttgagagaatcctgcatcatttgcttagatctttacatggcctttacctgctaatcacttgctaacctcccctaactttaagcttttggaagaattacaagggataccactgtgaattgcagcctttgctgatgtagtcgcatgtcctcctccagtctgtggacattctatatctcttgctgctctcctcctcctggcatgataatgttttgatcagttcattgcttacttgcatgtctgtgggaggaagaggaagtctcatcaggccaagtcatgtggtgaggctggaaatccataactgagattagctacccacagtgagcatgggagtgagtgctgtgagccacagtggtactgacgtcgactttctaattcccacagtcacagaatctcaaggactctgagccaattcaaagaaaagatcctgtacagtttgaatatgtaacttagcttaagagtaccctgcagtcacaagatttattaataaaagggtttggctttttaatttgtatttgtttaatttatttgttttatgcagcctgggtcttgctatgttgcccaggctggtcttgaactcctggcctcaagcgatccgctcgcctctgcctcccaaagtgctggaactataggcatgagccaccatacccagccaataaaggggtttcaatatatttctttttattttttattttttgagatggagtcttgctcttttgcccagggtggagtgcaatggcacgatctcagctcactgcaacccctacctcccaggttcaagtgattctcctgcctcagcctcctgagtagctgggactataggagcttgccaccacgcctggctaattttgtatttttagtagaaatggggtttcaccattttggccaggctggtctcgaactcctgacctcatgatctgcccaccttggcctcccaaagtgttgggattataggcatgagccactgtgcctggctgggttttagtatatttctcaattgtcctgatttcctcctgaagaggaaaaataacctgaaatgtgttggtggctgttgtttttttaacatgtctgttgactttcaggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaag

SEQ ID NO: 2513 - DNA, 61353 bp, Homo sapiens; identical to SEQ ID NO: 2512

SEQ ID NO: 2514 - DNA, 61353 bp, Homo sapiens; identical to SEQ ID NO: 2512

SEQ ID NO: 2515 - DNA, 61353 bp, Homo sapiens; identical to SEQ ID NO: 2512

SEQ ID NO: 2516 - DNA, 61353 bp, Homo sapiens; identical to SEQ ID NO: 2512

SEQ ID NO: 2517 - DNA, 61353 bp, Homo sapiens; identical to SEQ ID NO: 2512

SEQ ID NO: 2518 - DNA, 72927 bp, Homo sapiens
cttttctgcccttctttgctttggtggcttccttgtggttcctcagtggtgcctgcaacccctggttcacctccttccaggttctggctccttccagccatggctctcagagtccttctgttaacaggtgcatgggggtggggtgggggactctgggtggggaggagggtaacttttgggtctgtcataaatagagggcccagaatatgtaggagtcagtctggggagaggcaaaggggatttggggaaggagaaagggttcaagaagaagcagggagaacagctagacccagacaggctggccagggaagcctggatgaatgaccacattcatggactgtgcaaggctgcttgccggtccccttgcttcacacatgaggagacggaggcccagggaggagaagtgacatggctcagggtgcgcagcaggtgtgagacccctttcctgagtgcttcctcctggatcccctctcaccatctccactttgcctccggttctattttccaaggtcccgggtgcaaatgtttgttgaatgactgatgaatgaaaatgatttgagtttgttaccttttatgcttatatgttgtggaaaatgaaattctcctcaaaagggaaggaaatacttgagagctgcataggaaggaaattatctaattaagaatgtatagaaacttcactgttgggcaaatcatcgttgtgacaccgggggaagaagccatttaggtgctcagaagggaggctggaattcagagcaggactggacgtgccccacgacggtggttcttaggtcaggagtcagcaaacagtggcctgggggcccgatatggcccacgacctgtttttgcacaacctgccagctagagattgaagatgaacactgataatcgatttgatgatagggagcaccacccccaaagaattctatttgtctcatttgtaaacccgtattacaaacaaattgtactcaatcattatgtttgaaatttccctaatgacaaatttgtggaaaagtattttctgtcttgttatataagtacttgtacaacatattctatcagcctcttggtctgcaaaacctaaaatttactatctggctgtttacagaataagtgtgctaatccccgccccaggctaacagagctggacctgggaggcagacatctggatgctgggttagttagggtgaccgaatggatgggaaagggaatggagcaggaagacatgctgctatcttttttttttttttttttttttgatacagggtctttctctgttgcccaggctgtagtgcagtggcatgatcatggttcactgcagccttgacctcctgggttcaagcaatcctcccacctcagcctcctgagtaccactacacccggctaattttttattttttgtagagatggggtctcactgtgttgcctaggctggtcttaaactcctgagcccaggtgatcctcccacgtcagcctcttaaattattgggataacaggcctgagccaccacacccagccattgctttcttttaaattattattagtttttgttttttttttgtatttaattttgagataggatctctctctgttgctcaggctggagtgcagtggcacaatcagggctcaagtgatcctcctgcctcagccctccaaagtgctaggactacagcccctaactggcatgctactttcctctgcttgatccttcccccattctccctttagccttgaccttatgtcatgggttcaacttggacactgaaaacgcaatgaccttccaagagaacgcaaggggcttcgggcagagcgtggtccagcttcagggatccaggtgagacccttagatggagccccctttctcagtgctttctctccaagacttacatacctgaaaaaaatcagcgatttgagtgatctttttcaacagataaatcaattcaaaatatacaacaaattcatcttttgaatttacagtattctaaattcaaaagatgcaaaagggtgtaagagtaaaaatctcttccttactcccttcccctagttcccttcccaggagggacctcacaaatggtttcctgggtgttccttcggggagactctgtgtgtgcataacacatacacgttccctccctcagccaacacaccatgtgtagtatacattgtactgaaattaaggcctgcctgcaggctgccgcctatttttgtgaatgaattttattgaaaacaactccgtccacttgtctcttactgtttattgcccttccctcccttcctcccttccttccttccttccttctttccttccttccttcctccctctctcattccctgcttccctctttccctccttccctcccttccctcccttccatccttccttccttccttccttccttccttccttccttccttccttccttccttccttccttccttcatttctttctttcctttctgacatggtcttgttctgtcattcagcctggagtgcacaggtgaaatcatagctcactgtagactcaaactcctgggctcaagcaatcctcccaccttagcctcctgagtagctgggactacaggcatgtgccaccacacctggctaattttttgattttttttgtatagacgaggtctcactctgttgcccaatctggtctcaaactcctggcctcaagtcatcctcttgcttgggcctcccaacttgctgggatgataggtgtaaaccactgtgcctggctatggccacttttgagctgtaatggcagaattcaggagctgtgatagagattgtatggaccctgaagcctaaaacatttacctttacagaaacagtaattgtggaggtgatagtacctttccagaagaagggggctggtctctgctctttgctttatctcccataatacagcccagtgatttgagtccattaatcccatgttatgcttgcattgcatgccataattgggagatgctataatttattttattttatttttttagagactccctctgtcgcccaggctggagtgcagtggcatgatcttggctcactgcgacttctgcctcctgggttcaatcgattctcctgcctcagcctcctgagtagcttggattgcaggtgcctgccaccacgcctggctaatttttgtatttttgtagagacagggtttcaccatgttggccaggttggtcttgaactcctgagctcaggtgatccacctgcctcggcctcccaaagtgctgggattacaggcttgagccaccgtgcctggcttgtaatctccttttacattacattagatctcttgttaatgaacatttagattgttcccaaacttttgctctatgaacaatgctgtcattttgcacatgtgcaagcctatttggaagtaaaggctaggactgggattgtggtatccacgggtgcatgagcacgtgcaattttaatagatttttccagatccccctctacagtggtggcagcaatttacactcacaccagaaattcatgaaaatacctacttcctcatactccctcactcatttgccaactcagtgtgctatcaaacttactgatctctgcagatcgagtaggtgagaagtggtatcttaatttagctttaaattgcttcttttttttttatgagagaggcattttctgtgaacatgtttttcttatctgttggccatttttctttctttttttttttttttactagtttgtacaagctttgagtacactgaggaaagtagtctggggtatgagttgtgaagctctctcccttgtgtattatttttcttttgagtatgcttatggtagtttatcacatacaaaaatttatttatttatttatttatttatttatttatttatttatttatttattgagatggagtctcgctttgtcgtccaggctggagtgcagtggagtgatctcggctcactgcaacctctgcctcctgggttcaagcgattctcctgcctcagcctcccgagtagctgggactacaggtgcgtgccaccacgcctggctaatttttttgtatttttagtagagatggggtttcaccatgttagccaggatgttctcgatttcctgacctcgtgatccacttgcctcggcctcccaaagtgcagggattacaggtgtgagccactgcgcctggcccagaaatttattgaaaatgactgtgtggaggctgggtgcaggggctcacgcctgtaatcccagcattttgggaggccgagctgggctggtcgctggaagccaggagttcgagactaccctggccaacataaggaaacctcatctctactaaaaatacacaaattagccaagcatggtggcacacacctgtaatcccagctactcaggaggttgagacaggaggaatgcttgaacctgggaggcagaggttgcagcagtgagccgagattgcaccactatactccagcctgggtgatggagtgagaatctgtttcaaagaaagaaaataaataaaaataaaaataaataaaatgactgtgtgggccgggtccagtggctcatgcctgtaattctaacactttgggagactgaggtggaaggattgtttgagcccaggaggcagaggttgcagtgagctatgattatgccactggactccatcttgggcaacagggtgagaccctgtctcaaagaaaaaaaaaaaatggttggcctgggactacaggtgtgtaccaccatacctggctaatttttaaaaacattttttgtagagatggggtctggctatgttacccgggctagtttcaaactcctggcctcaaatgatgctcctgcctcaacctcccaaggtgctgggattaaaggcatgagccatggtgcccagcttgaattgacctatttttatttttaaaatttattcatttattttttgggacagagtcttgccctgtctctcaggctggagtgcagtggtgctatctcggctcactgcaacctctgcctcctgggttcaagcaattctcttgcctcagcctcccatttagctgggattacaggtacgcaccaccacgtgtggctaattttttgtatttttagtagaggcggggtttcaccatgttgcccaggctgatcttgaactcctgagctcaggcaatccacccccttggcctcccaaagtgctaggattacaagcatgagccaccgcgcctggtcctatttttaaatgacttctggtttttgtgtcattcttaggaagaccttttctcattctgagtcttaacattttcccatttttttctttgctaattcttcctcctagtcataggaatttaggaatccgggtatgggcccccaccgtcctctgggtggcagaacttcctctgtggtctccttctctccccacatgtcgaagttttctctgttcccacttctccccacagggtggtggttggagccccccaggagatagtggctgccaaccaaaggggcagcctctaccagtgcgactacagcacaggctcatgcgagcccatccgcctgcagggtgagtcactgccccgccgggctgggactgggattcccctgtgaacacatagggactttccaggcactcctgtgtcctggggatctgtggtggggacacaggtgcctgcctccgtaccctctcctctgcctgcagtctctaccctagacatccccaggcaacccctctgtgttcctttctttcccaagatttaggatcccccttcaccgtcagacctccttgtctcccgcatggaggtgacccctgcccagctcttccacagccttctctgtccccccaccagggtgaccatgcccatatctgtccccgcagtccccgtggaggccgtgaacatgtccctgggcctgtccctggcagccaccaccagcccccctcagctgctggtgagtggggctcgatcagaggagcatcctaatgggggtgtttgggggcccacgcatggtggggctgggggtcttgtggagggtggaggtgctggggtacaaggacaggaagcaggggcagccccttccactggctcctgtcccctaggcctgtggtcccaccgtgcaccagacttgcagtgagaacacgtatgtgaaagggctctgcttcctgtttggatccaacctacggcagcagccccagaagttcccagaggccctccgaggtgggttgcctttggcagagggaacagatgcgcagcaaaagaccaggggagggggcaggactgaggtgacgtctgctcaaggtctgggctctgggtgcagaagagtgggggaactgggtcccattagagtcagaagctagggaggtgctagggtcttgtactttaggaaaacgccttggctaggcacagtggctcatacctgcaatcccaaagctttgggagcccaggagcttgagatcagcctgggcaatgtagtgagatcctgtctctaaaaaaaaaaaaaaaaaaaattagctgagtgtggtgatgagcacctgtagtcttagctatttggaggccaaggtgggaagattgcttgaggccacaagttcaaggcaagcctgggcaacatagggagatccccgtctctacaaaaaaaaaaaaaaattagccaggcgtggtggcacacacctgcagtcccagctactcaggaggatcacttgagcctgggaagttgaagctgcagcaagttatgattgcaccactgtactccaacctgggtgacagagcaagaccctgtctttaaaaaataagtccaggtcacactgcagaggaggggatggtgcaaggtgtcattggcaagaggtgggaatcttggggaccatcctggggggcggccttccacacccctgttccccaaacctctgttgattgagattctgagtgactgtatggatttttttttttttttttttttttgaggcagagtctcgctctgtcacccaggctggagtgcagtggcacgatcttggcttactgcaacctctgcctcccaggttcaagcgattctcctgccccatcttcccaagtagctgggattacaggtgcccgccaccacacccggctaatttttgtatttttagcagagacggggtttcaccatgttggccaggctggtctcgaactcctgagctctggtgatctgcccaccttggcttcccaaagtgctgggaatgagccagggaatgagtggggggcatgagccaccatgcctggccagagtgcgtggatctttcaagctgctttttcccactgctttgttcgatggctatgccatctttttgcttgtcttcatgttgattctgggaccacaggcgaatgtttctcccttgcattttttttctttctcaagccctgttcctctatatttcaccctccacagttaatcctccttcctccacagagaaaacaaaagcttcaggcatggactccctccactttccccttctcttattttatcttaataagcggttttccagtcttcactggaatttgttgacaaattctaaaggagctgtaacaccgcactttctcctttttctcaaatttccataatgacagcactcctggcagtgactcactcgttttagaggaagacctgtctctcctctgtcccatgactaaattcttccatatgggcttttgagagtctctcatgcaccaactaaggtgatcacctatctttcttttttcttttttttttggagacagggtcttgctctgtcacctaagctggagtgcagtggcacaatctcggctcactgcagcctctgcctcctgtgctcaagaaattcttgtgcctccgcctccagagtagctgggatcacaggtgcgcatatactgatttttgtattttttgtagagatggggtttcaccttgttgcccaggctggtctcgaattcctgggctcaagagatcttcccacctcagcctcccacagtgctgggatcacaggtgtgagccactgcgcctggcccagcatctcttgaatcacttgttttctctctaggacaattaacttcccccttcctctggctgtaaacactcttcattctatctgtatctgaaaagcaatcaaccaccacaatcgatagccatgaaaacaatcttctctcttccagtctcctcctcatctcctgccatctctcctcaccctcaccacccaagcttcctgagtgcattctcttcacccccggctggcctccagcttccctctccacctaggggcactgggttctgggttctcttttcacccacgtgttcttctttcctgaaatcacccagttctgtggcttcagctaacacttctacctctccctctttagacctcactctcagggttcaagactacttctttaaaaaagttttcatttattaaaaaatatataatacatacacttggttcaaaattcgaaagggtgcggtagctcacacctgtaattccagcactttgggaggtcaaggcaggaggattgtttgaggccaggagtttgggaccagcctagacaacataatgagaccccatctctacaaaaaatgcaattagccaggcatggtggcgtgtgcctgtggtcttagctattcaggaggcctcccaaagtgctggggttacaggcatgagccactgtgccctgccagtctttctaaaatacaaaacaaatcatctcacttccttttctaagaaccttctgtggctccccattgcctacagataaagtcgagctccttattggagtagaaaggcccttgcccgctgctctttgcttgatgccaccgctgtgtctccatcgccgtcacatacgtttgtccctgtagtgctgtttccatcaaacggcattcctggattctgccagaatccttttgaggcccttgtcccatatatcagtaggagtctcaactgggaccaaaagcacattccagtaatgtaactgcccaaggggttcaccttgcttgctgcctagacagagccgattcatcaagacagcagaattgcgatagagaaagaataattcacacagagccagctatgcaggggaccagagttttattatcactcgaatcagtctcctcgagcatttgggggcagagtttttgaggataacttggtaggtcgcgggggaagccagtgagctgggagtgctgattgatcagggatgaaatcatcgggagtcggagctgtcttcttgcgttcagttggttcctgggtgggggcagcaagatcggatgaaccagtttattgatctgggcagtgccagctgatccatcaagtgcaaggtctgcaaaatatctcaagcactgattttaggagcagtttagggagggtcagaatcttgtagcctccagctgcatgactcctaaatcataatttctcatcttgtggctaacgttagtcctacaaaggcaatctagtccccaggtaagaaggaggtctgctttgggaaagggctgttacgatctttgtttaaactataaactataaactataaactaagtgtctcccaaagttagctcagcctacacccaggaatgaacacggacagcttggaggttagaagcaagatggaatcagttaagttagatctctttcactgtctcagtcataattttgcaaaggcggtttcagtaagatttatttacaaagaggggggtttatttataaagggagtaattataaagctgtgacaggcctaagggagccatcagggactttccaagccctgggcaagcaggtctgttgccacccctgggtttatgggttgaggagagggagagctcaccagggtctggagagagtcatgtggagctggcttccttctgaggaacagttggtcttttgtgaaggacatagctgtccccaaacaacctcaatgggagaacacccggacctcactgccctcctccctctagtcttctgttgagccccctcatctgccaaatccaatgggaatccagagggcaacagagtcctggtgatggggtccctgcaggttgacctcccaggccacagagctgagcggcaatgggtagaaagtggatttggggatggggcagaaggcagaggagcacattccacatcactttatatgtgtgtgcccttcccttttctagaatctactccttttgtatatctggcaaatccttccttccttccttccttccttcctcctttgctttcctttcctttcctttcctttcctttcctttcctttcctttcctttcctttttttcttcctttcttccttttcttcgaagtcttgctctgtgacccaggctggagtgcagtggtgcgatctcagctactttttgtatttttaatagagatagggtttcaccatgtcagccaggctggtctcaaactcctgatctcaagtgatccacctgcctcagcctcccaaagtgctgggattacaggtgtgagccacctcgcccagctgggcaaattatttcctgttcttcaagattcagtcaaacatcaccacattccctgattcccttgggcagaattaacgaaaattttccataccactttgtccttgtttatttacttatttatttatttttaagagacagggtctttctctgtggcccaggctggagtgcaatggcgtgatcatagctcactgaagcctcaaccttttgggctgaagtgatcccccaccctcagcctcctgagtagctgggactacaggcatgtgccaacatgcctgactaatttttaacgtgtgtgtgtgtatatatatatatatatatatatatatatatatatatatatatatgtttttaacgtgtgtatacatatatatatatacacacacgttaaaaattatatatatattatacataatttatatatatatttaacatctatattttttatagagacggggtcctatattctcattgttcagcagagggctgacatgcaaaaaaacccaaaacaccaagtgtcaaattacttgattcatactcttttccccttccccagggtgtcctcaagaggatagtgacattgccttcttgattgatggctctggtagcatcatcccacatgactttcggcggatgaaggagtttgtctcaactgtgatggagcaattaaaaaagtccaaaaccttggtgagggcccaggggtaggttagggaagagcccacacggggctggaagatacatggcaaccgggccaccatgttctcctcccagttcaactgcagacattgccaaattgacgatcgattatggtttgccttcctgagtctcttttctgctctgttggatgcagcctcagcattctttcagccttttataaagcgggcagctctaattgttaaggttggcatgggagatgaagcccacgtgtcattgctggctgagttctattttcatttttatttcttatttttttgagacagaatctcactctttctctcaggctggagtgcagtggtgtgatcttggctcactgcaacctccgcctcccgggttcaagcaattctcttgcctcagcctcccgagtagcggggattacaggcgcatgccaccatgcctggctagtttttgtatttttagtagagacggggtttcaccattttggccaggctggtctcaaactcctgacctcaggtgatccacccgcctcggcttcccaaagtgctgggattacaggtgtgagccactgctcccggccgctggccgtgttctagtattgaggagagatgggagctgctggcagctctccgtcctggtgaggcaggggattaggggcagcacagaggaggaatttggagagtggagtgtttaagatcttcgtggagcttgctgggagatgtctgaggggtgggggcaccttctccagcatcacaccagccgccccctccgcagttctctttgatgcagtactctgaagaattccggattcactttaccttcaaagagttccagaacaaccctaacccaagatcactggtgaagccaataacgcagctgcttgggcggacacacacggccacgggcatccgcaaagtggtgtaagcttccccttttcccttaggatggagggaggaggagacacttttagctgggctttgatggatgaagggagccgttcagacaggggtggtagaggatgcttccccaccggcagaggtggggaggctgtgcgtggtgtgttcatcaaaggacaagttgtgagtgaaaggtgggagtggagtggggaagtgagggaaaggtgtctggagggaagctacaaagatcagctcaggccagggagccaaaggcagctttacagcctgtggtgagatatcgccatgtctcattttgggaagttcactctgattttgaggtgggtgtagaggcaaggatggggttgggacagaagtacaagaagcactggagagtcctagaggggctggggagctggtgcagtgctctgggagaggtttcctgaaggccaattaactatatatatatatatatatatatatatatatatatatatattttttttttttttttttttttttttttttttttttttgagacagagtctcactctgtcacccaggctggaatgcagtggcctgatctcggctcactgcaacctccacctcctgggttcaagcaattctcctgcctcagcctcctgagtagctgggattacatgcgtccatcaccaccatcagctaatttttgtatttttagtagagacagggtttcaccatgttgaccaggctggtcttgaactcctgacctcaggtgattcacctgacttggcttcccatagtgctgggattacaagtgtcagccataaatatatatatttttaaaattcaaaagtaataatactcagttaaaaaacccaaattatgcgaaagtataaaaacaaaaaccgtgaaggcttcctttcccttccctgctgcttttccaggtctcggggcagttgcatctcagtgctaagtctcaggggagacggagcccctccgagacctcgcctagctgtatctgtgtctgggactctgctgacatttcctttctgacgttaatagcatctctggctaggtgcagggtctcataccagtaatgtcagcactttaggaggccgaggtgggaggatcacttgaggccaggagtttgagaccaattgacaacatagtgagactctatctctaaaaagataaaaaaataaaccaagtgtggtggtacatgcctgtagtcccaggtactcaggaggctgaggcaggagaatcacttgagcccaggagttcaagtctgcagtgagctatgattgtgtctctgcactccagcctggataacagagtgagtgtctatttcttaaaaaaaaaaaaaaactagtgtgtcatctacttgcatttgactttgtccctcctgtttcctgcacagacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtagggaatgcagctctcaggttgatgcttctgtggagggtttctatgtggatccatcctcccttcaatttgcaaatattattaaaatcaaagtgacatgagagctaatgctagctcatatacaccgtatcagctatctgttgccacatcaatgctgtgtaataaactatcccaaaattcagcagcttaaaataataagtaagcctgtgggtcagcctgccaagagttctggtctcaatggccttcctcactgtcattagctacaggttggcaggctgctctgctgatcttggccaggctctctctgtttctgagggttgccagctatgtcatctgctggaccagatggccttgggtggaaccactggggtgacttggccctttggcaacctggctctcattctccagggctagcctgggcatgtcctcatggtgaaggcaggggagcaagagaacagtggagatgttgcaagtgcttttttacgcctctgcatcatgtttgataacatccatgggtgtcacgagcagtgcaaggttagcgataaccaggtccatgcaggtttgtgtttttccacaacatctttcgctgatgctatttcaatcacaaacgccacaagctgcatggaattcccaaggaggcagttcttcttagtgcatcctgttccctcagacactctggctcaagccacccacaagtcagtcaatattgcaaaccatatataatagtatacttaatcaatatataagttataggttaaacattccacagcaaacaaagtaacatttaacatcagaagaaaaagaaagaggagaaaggatgaatgaaaaggactcctggtctgggcccaagggtcctggtcctgttagtcttgcaaggcagagtctttgatacggcagagccctcggcagcaaatgccaggctctcatcatgagcgactgcgaggtgtgagttccaacagctgctttgagctgctgaaggcctgatctcttctagtcacagagctgtctggtgagaacagacagagaagaatgtgcttgtttgcatccttatctggttggatgtagtctttatttgtttattttatttatttatatttatttatttatttattttgagactgagtcttgctctatcgctcaggctggagtgcagtggcatgatcttggctcactgcaacctccacctcctgggttcaagcagttcttgtgcctcagcctcctgagtagctgggactacaggcatgcaccaccatgcctggctaatttttgttttgtattgttagtagagatggggtttcaccatgttggccaggttggtcttgaactcctgatctcaagtgatctgcccgccttggccttccaaagtgtgggattataggcatgagccactgcacctggcctatttaaaaaatttgtttaaaacgaccttatccttgttggcaaagtgccctgtgaaatatagaatggagcctttttctaagatggagtcagttatgtcaagggtgctctgtatacaatgggctaaagcaagactcatgtctgagcccagaggcaatgaagggggcagatgactccaccaagagcaggagggcacagcagagtgctgggggaaagggcttggatacaggaagaggcaaggagtcaggatcatcagtgtaatcaaactactacagcacctgcatgacacagaaagcgatatcaccatggatacatgccttggcacgtaggacataccttcatataaagaaaaaggctccccttcctctagggggaggtcagctccataccaggagacgtggcacagcagatggatcagcagccgggtttctgccccaacttgcttccttggcacagtgccttgtgcagtgtacaacctgcccaactatacctggcaaccctgtcccagggaccttctgatgcatttcctcacttgataaataatggttcagactagtttcctgcagaattgtctttgccagatgatattgctagcctcacaccatgatttagcctctgttccttggtaacaggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtgagtcaggcatctgtgttcccagagcagctccagaggcagccccccaccccagaacatagtcccctctagaatccagaccttcctaacccttggtatcccccagcatcaactctctccacttcctacagctcccagtcccagcctcacttggtcaattcctttgaagtcaaagaatccatacttttatctgtaattttgcaaatcttggctataggctggtaaattggagtatgggggagtcaaatcccacccagtattttaacaaaaatttggatgtgttgccagctgtcgtctgttcggttctctgttgtatcccaattgcctagaatagtgcctggtactcagaaggtgctcaataaatgtttgttgaataaaaggaatttagaaattgggggatttcataaacagtctgggtttatggcttatcttgaaaagctggaagattagacaccttgaagaccgcattcccacttggcaggatgttgctggaggtgaatggctgccatccttctaagagggacgtatgctgtccagcttgacacagatcctgtcggagtctcctttgtctgtggccaccagagcacttgggttttcagtacctgttctaggttcttctgctttcttttcttttctttctatttttttttgagactgagtcttgctctattgcccaggctggagtgcagtggtgcgatcttggctcactgcaacctctgcctcccaggttcaagtgattctcctgcctcagcctcctgagtagctgggattacaggcgcataccaccacgcccagctaatttttgtatttttagtagagacggggtttcaccatgttcaccagactggtctctaactcctgacctcaagtgatctgcccatctcaggctctcaaaatgttgggattacaggcgtgagccaccatgcccggccttctgctttctttaatatagaaacttctcctctttacaggtactcagacaggaagtagcagctcctttgagcatgagatgtctcaggaaggcttcagcgctgccatcacctctgtaagtggcccttcattaaattgcgggggtggggcagggggtagcaagaagagataggagagatgtgggggtttggggactcttctctgtgatagatacttgggaagtagctctgtgaggggcagcggttgtcccttcttccttcctcatcaaccctgttctacacctttcccagaatggccccttgctgagcactgtggggagctatgactgggctggtggagtctttctatatacatcaaaggagaaaagcaccttcatcaacatgaccagagtggattcagacatgaatgatgcttacttgggtaagtggggagggcaagggttactctaagaaggggtgaggatttggcataagtcaactagcatagatgtctgggtcttgaatgaatgggatacatatgtatgggatactagctattagtctcttgggatagctttaaagacagaaacttcaatttttttttttgaggtggagtttctttcttgtcgcccgggctgtagtgcaatggcactcggctcactacaacctctgcctcctgcgctcaagcgattctcctacctcagtctcctgagtagctggtattacaagaatgcaccaccacccctggctaatttttttttttttttcgaaatggggtttcgctcttgttgcccaggctggagtgcaatggcgtgatcttggctcaccacaacctccgcctcccaggttcaagcgattctcctgccttagcctcctgagtagctggaattacaggcatgtgccaccatgcccagctaattttgtatttttagtagagatgggatttctccatgtcggtcaggctggtcgcgaactcccaacctcaggtgatccacctgcctcggcctcccaaagtgctggaattacagacgtgagccaccgtgcctggtctttttttgtattttcagtagagaccgggtttcaccatgttggccaggctcgtctggaactcctgacctcaggtgatccgcctgtctcggactcccaaagtgctgggattataggtgtgagccaccgcacccggccagaaacttctaaattgaattgtaattatgttcataaagagaaatatagcgtagggatcagttaccccaacacagcaagcgtggggctgccccagtgcccctactcaaggggtgggtctgcatggtggaggagggggcagggaatgcacttcacctctcagacccccaccttcaggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccaggtgagtgcggtttgtggagcatgaatgtgcaaacagaggcgccctggggtcttagagattccaggaggggcattcagatgacatgcatggccctcttgtaaaggaggctttgggggctgtgagctggggagttgtgggatcagcttagcatttgtgaatgctgtgtcctcagcttttttaacaatgataaataacaatgcttgcctgtacagagctctctatgggtctttctgtactcagggctggtattcaacccgtatataaccaggatagccatgttagttaataaaatattgaaacaattccgtattcattgataaatggtggattccccctcacccatgcactctggtgcttccccagtctctgtgggcttccccatgatccagcaactatgaggtcaggcaggacacttcacacaccctctaggatctgctccagccatgcccctgctcagtacctgtgcagctccagctgttcattattttgaatatcacccctgcaaaagcagcatggtcacatattatgtgggaactagcgagtgaggcaaaactctctagtcaaaatcattcttgcaaattcctgaaataggactgcacccatgatatggtgcctatagttctttattttatttttattttattatactttaagttctagggtacatgtgcacaacatgcaggtttgttacatatgtatacatgtgccatgttggtgtgttgcacccattagctcgtcatttacattaggtatatctgctaatgctatcccttccctctccctccaccctacgacgggccctggtgtgtgatgttccctacctggtgtccaagtgttctcattgttcaattcccacctatgagtgagaacatgcagtgtttggttttctgtgcttgcaacagtttgctcagaatgatggtttccagcttcatccatgtccctacaaaggacatgaactcatccttttttatggctgcatagtattccatggtgtatatgtgccacattttcttaatccagtctatcgttgatggacatttgggttggttccaagtctttgctattgtgaatagtgccacaataaacatatgtgtgcgtgtgcctttatagcagcatgatttataattctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacgtgttgtttcctgactttttaatgatcaccattctaactggtgtgagatagtatctcactgtgattttgatttgcatttctctgatggccagtgatgatgagcattttttcatgtgtctgttggctgcataaatgtcttcttttgagaagtgtctgttcatatcccttgcccagtttttgatggggttgtttgattttttcttgtaaatttgtttaagttctttgtagattctggatattagccatttgtcagatgggtagattgtaaaaattttctcccattctgtaggtggcctgttcactctgatggtagtttcttttgctgtgcagaagctctttagtttaattagatcccatttgtcaatattggcttttgttgccattgcttttggtgttttagtcatgaagtccctgaccatgcctatgtcctgagtggtattgcctaggtttccttctagggtttttatggttttaggtctaacatttaagtctttaatccatcttgaattaatttttgtataaggtgtaaggaagggatccagtttcagctttctacatatggctagccagttttcccagcaccattattaaatagggaatcctttccccatttcttgttttttcaggtttgtcaaagatcagatggttgtagatgtgtggtattatttctgagggccctgttctgttccattggtctatatttctgttttggtaccagtaccatgctgttttggttactgtagtcttgtaatatagtttgaagtcaggtagcgtgatgcctccagctttgttcttttggcttaggattgacttggcaatgtgggctcttttttggttccacatgaactttaacgtagctttttccaattctgtgaagaaagtcattggtagcttgatggggaaggcattgaatctatgaattatgttgggcagtatggccattttcacgatattgattcttcctatccatgagcatggaatgttcttcaatttgtttgtgtcctcttttatttcattgagcagtggtttgtagttctccttgaagaggtccttcacatcccttgtaagttggattcctaggtattttattctctttgaagcaattgtgaatgggagttcactcatgatttagctctctgtttgtctgttattggtgtataggaatgcttgtgatttttgcacactgattttatatcctgagactttgctgaagttgcttatcagcttaaggacgttttgggttgagacaatggggttttctaaatatacaatcatgtcgtctgcaaacagggacaatatgaataccctttatttctttctcctgcctgattgccctggccagaacttccaacactatgttgaataggagtggtgagagagggcatctctgtcatgtgccagttttcaaagggaatgcttccagtttttgcccattcagtatgatattggctgcgggtttgtcataaatagctcttcttagtttgagatacgtcccatcaatacctagtttatttagagttttcagcatgaagggctgttgaattttgttaaaggccttttctgcatctattgagataatcacgtggtttttgtctttggttctgtttatatgatggattatgtttattgatttgcatatgttgatccagccttgcatcccagggatgaagcccacttgatcatggtggataagctttttgatgtgctgctggattcagtttgtcagtattttattgaggatttctgcgttgatgttcatcagggatattggtctaaaattctcttttttttgttgtgtctcttccaggctttggtatcaggacgatgctggcctcaaaaaatgagttagggaggattccctgtttttctattgactggaatagtttcagaaggaatggtaccatctcctccttgtacctctggtagaattcagctgtgaatccgtctggtcctggactttttttggttggtaggctattaattattgcctcaatttcagagcctgctattggtctattcagagattcaacttcttcctggtttagtcttgggagggtgtatgtgtccaggaacttatccatttcttctagattttctagtttatttgtgtagaggtgtttatagtattctctgatggtagtttgtatttctgtgggattggtggtgatatcccctttctcattttgtattgcgtctatttgattcttctctcttttcttctttattagtcttgctagcggtctatcagttttgttgatcttttcagaaaaccagctcctggattcattgattttttgaagggttttttgtgtctctatttccttcagttctgctctgatcttagttatttcttgccatctgctagcttttgaatgtgtttgctcttgcttctctagttcttttaattgtgattttaaggtgtcaattttagatctttcctgctttctcttgtgggcatttagtgctataaatttccctctacacactgctttaaatgtgtctcaggattctggtatgttgtgtctttgttctcattggtttcaaagaacatctttatttctgccttcattttgttatgtatccagtagtcattcaggagcaggttgttcagtttccatgtagttgagcggttttgagtgagtttcttaatcctgagttctagtttgattgcactgtggtccgagagacagtttgttataatttctgttcttttacatttgctgaggagtgctttacttccaactatgtggtcaattttgtaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctgtgtaggtcactaagcacttgctttatgaatctgggtgctcctgtactgggtgcatatatacttaggattgttggctcttcttgttgaatttatcggtttaccattatgtaatggccttctttgtctctttgatctttgttggtttaaagactgtttcatcagagactaggattgcaacccctggttttttctgttttccatttgcttggtagatcttcctccatccctttattttgagcctatgtgtgtctctgcacgtgagatgggtttcctgaatacagcacactgatgggtcttgactctttatccaatttgccagtctgtgccttttaattggagcattgagcccatttacatttaaggttagtattgttatgtgtgaattagatcctgtcattatgatgttagctggttattttgctcgttagttgatgcagtttcttcctagcatcggtggtctttacaatttggtatgtttttgcagtggctggcactggtttttcctttccatgtttagtgcttccttcaggagctcttttagggcaggcctggtggtgacaaaatctctcagcatttgcttgtctgtaaagtattttatttctccttcacttatgaagcttagtttggctggatatgaagttctgggttgaaaattcttttctctaagaatgttgaatattggcccccactctcttctggcttgtagggtttctgctgagagatcagctgctagtctgatgggcttccctttgtgggtaacctgacctttctctctggctgcccttaacattttttcctccatttcaactttggtgaatctgacaattatgtgtcttggagttgctcttcttgaggagtatctttgtggtgttctctgtatttcctgaatttgaatgttggcctgccttgctagattggggaagttctcctggataataccctgaagagtgttttccaacttggttccattcgccctgtcactttcaggtacaccaatcagacgtagatttggtcttttcacatagtcccatatttcttggaggctttgttcatttctttttactctttttttctctgaacttctcttcttgcctcatttcattcatttgatcttcaatcactgataccctttctccacttgattgaattggctactgaagcttgtgcatgcatcacgtaattctcatgccatggttttcagctccatcaggtcatttaaggtcttctctatgctgtttattctagttagccattcgtctaatctttttacaaggtttttagcttctttgtgatgggtttgaacatcctcctttagctcggagaagtttgttattaccgatcatctgaagccttctcctctcaactcgttaaagtcattctccgtccagcttcgttccattgctggtgaggagctgtgctcctttggaggagaagaggtgctctgatttttaaaattttcagcttttctgctctggtttctccccatctttgtggttttatctacctttggtctttgatgatggtgacatacagatggggttttggtgtggaaatcctttctgtttgttagttttccttctaacagtcaggaccatcagctgcaggtctgttggagtttgccggagttccactccagaccctgttttcctgagtttcaccagtggaggctgcagaacagcaaatattacaaaacggcaaatgttgctgcctgattcttcctctggaagcttcgttgcagaggggcacccagccgtatgaggtgtaagtcggctcctactgggaggtgccccccagttaggctacttgggggtcagggacccacttgaggaggcagtctgtctgttctcagatccaagctgcatgctgggagaaccattactctcttcaaagctgtcagacagggacatttaagtctgcagaagtttctgctgccttttgttcagctatgccttgcccccagaggtggagtctacagaggcaggcaggcttccttgagctgcagtgggctccacccagttcgaacttcctggccgctttgtttacctactcaagcctcagcaatggtggacgcccctcccccagcctcactgccaccttgcagcttgatctcaaactgctgtgctagcgtgagcaaggctccatgggcgtgggaccctctgagccagacgcgggatataatctcctggtgtgccatttgctaagaccattggaaaagtgcagtattagggtgggagtgtcccaattttccacttactctctgtcacggcttcccttggctaggaaagggaattccccaaccccttgcacttcccaggtgaggcgatgacccaccctgctttggctcatactctgtgggctgcacccactctcctacaagccccagtgagatgaacccagtacctcagttggaaatgcagaaatcacttgtcttctgcgtcactcacgctgggagctgtagactggagctgttcctattcggccatcttggaacctcctctgcctatagttctttaaaaaaaaaaatttcaggcagggcatgttggctcatgcctgtaataccagtgtagcaggacaagctgcatacaaaacccctcagacaccgagttaaagaaggaagggctttattcagtcaggagctacagcaagactcacgtctccaaaaactgagctccccgagtgagcaattcctgtccttttaagggcttaaaactctaaacaggtccacgtgagggggtcgtgatcgattgagcaagcaggaggtacgtgactgagggctgcatgcaccagtaaacagaacggaacagaacaggacagagattttcacaatgcttttccataccatgtctggaatctatacataacataactggttaggtcatgagttgatctttaaccagacccagggtgcagcacagcccgtggatttaatttctgccttttagtttttacttctttctttggaggcagaaattgggcataagacaacatgaggggtggtctcctcccttaccagcactttggaaggctgaggcaggtggatcacctgaggtcaggagtttgagacgagcctggccgatatggtgaaactctgtctctactaaaaataaaaaatattaaaaaaagttagccaagcgtggtggcgtgtgcatctgtaatcccagctactcgggaggctgaggcagaagaatcacttgaacctgggaggcagaggttgcagtgagctgggatcttgccactgcactccagcctggatgacagggcgagacttcatctcaattaaaaaaaaaatttcaagttttagatttggggtacatgtataggcttgttacatgcatacattgcatgttgctgaggtttgggctgcagatcccatcacccaggtagtgagcatagtacctgtggtggtttttcttttttctttttcttttcttttctctctctttttttttttttagagacagggtctcactatgttgcccaggctggttttgaacacctgagctcaagcaacgttgcccaggctggttttgaactcctgagctcaagcaatcctcctgccttggcctcccaaaatgctgagattacaggtgtgaaccactgcgcctggcccaataggtggttttccaacccacacctcctgctcctccatctggtagtctgcagtatctatcattcccatctttatgtctatgtatacccagtgtttagctcccacttataagtgagaacatgcagtatttgattttctgttcctgtgccaattcacttaggattatagcctccagctgcatccatgttgccgcaaaggatgtgattcatttttttttttatggtggcgtagtatttgatggtgtatatgtaccacattttcttttccaatccaccactgatagacacctaggttgattccatgtctttctattgtgaatagtgctgtgatgaacatacgagcatgtatctttttgatagaacagcttattttcttttggatatatggccagtaatgagattgctgggctgaatagtagccctgttttatattctttgagaaatcttcaacctgctttccacagtggctggactaatttacattcccaccagccaacaatgtataagcgttcctttttcttcattgccttaccagcatctgttattgtctttttaataatagcattctgactggtgtgagatggtatctcattgtggtttatgatttgcatttctctggtgattagtgataatgaactttctttttcaaatgttttttggctacttgtatgtcttcctttgagaagtgtctgtttatgtcctttacccactttttaatggggttatttgtttcttgcttgttgatttgttgaagttccttatagattctggatttcagacctttgtcagatgtggtttgcaaatattttctcccattctgaaagttttctgtttactctgttgatagtttcttttgctctacagaaactctttaattagttcccacttgttgatttttgtttttgttgcagttgcttttgagggcttagccgaaagttctttgccaaggctgctgttgagaaagtatttcctaggttttcttcaatgattttaatagttcgagggctcacatttaaatctttaatccatgtgatttaagtctttaatcacatttaaatctttaatacaccttgagttgatttttgtataaggtgtaaggaaggggttcagtttcattcttctgcatatggatagccagttatctccacactctttattgaatagggagttctttccccattgcttgcttcatagtctttattgaagatcaggtggttataggtgggtggctttatttctgggctctctgttctattccgttggtctatgtgtctgtctttgtaccagtaccatactgttttggttactatagcctcatattcggatagtgtgatgcctccagctttgttatttttgcttaggattgcttttgctatttaggctctttttttgttccgtattaattttagaatagttttttctatctgtgaacaatggcattggtagtttgatacaaatagcattgaatctgcaaattgctttgagcagtgtggccattttaacaatattgattcttccaatccatgagcatggaatacttttccgcttatttgtgtcgtctctgatttctttcaacagtgtatttctctttgtagagaccttttacctccttggttagctgtgttcccaggtacttcatttttcgtttctgcctgtagttctgtgtgtttttaaaatttttgtcggtggttctctttgacttgtaattaatgcattgtatggggatgaaaccagtttctcctgatacctgaacagcttgtcataattctttgccaatagtcaaattcttcacgtggtctctctaaacacatactggccattgatggtgtcaatgcctgacatgtataagggatggggtggggaaaaaagtgtagaggaattacgggaagtcaagtgtggattggatgccacttctctgttttcggtgtgtggtcaggaccacatgaggaaggctggctggtcaactcccccaccccacacaagtacacgcacattaccatcaagggtgatagatgcttaaagtgggacagtctgggagttatgagagcaaatgggaggggcacccacagaaaggcagtatggaagccttcctggtggaagtggcagctaagccaaggcctgaggtggaagcacaagagaagtgaaaaggggtgtggggaagcaaggggccagaggagggagagagaatggaatggagggtcagaatatgcgtatagggtggtgggaggagtggtgggagaaaacaggaaagaagggtaggtgtggcttatcccagacatgcagggcttgttcaatatcccaaataccaatattgcagaaatggacaagctgatcctgaagtccatatggaaacagaagggacccatatattagacttatacctaaatgtttcatgacctttggcactattgtaaattgtactggtttttaaatttaaatttccaattgttggaacagaacagagccctcagaaataattccacatgtctacaaccatctgatctttgacaaacctgacaaaaacaagaaatggggaaaggattccctatttaataaatggtgctgggaaaactggctagccatatgtagaaagctgaaactggatcgcttccttacaccttatacaaaaattaattcaagatggattaaaagcttatatgttagacctaaaaccataaaaaccctagaaggaaacctaggcattaccattcaggacataagcatggtcaaggacttcatgtctaaaacaccaaaagcaatggcaacaaaagccaaaattgacaaatgggatctaattaaactaaggagcttctgcacagcaaaagaaactaccatcagagtgaacaggcaacctacagaatgggagaaaatttttgcaatctactcatctgacaaagggctaatatccagaatcatcaaagaactcaaacaaatttacaagaaaaaaacaaccccatcaacaagtgggtgaaggatattaacagacatttctcaaaagaagacatttatgcagccaacagacacatgaaaaaatgctcatcatcactggccatcagagaaatgcaaatcaaaatcacaatgagataccatctcacaccagttagaatggtgatcattaaaaagtcaggaaacaacacgtgctggagaggatgtggagaaataggaacacttttacactgttggtgggactgtaaactagttcaaccattgtggaagacagtgtggcgattcctcaaggatctagaactagaaataccatttgacccagccatcccattactgggtatatacccaaatgactataaatcatgctgctataaaggcacatgcacacgaatgtttattgcggctctattcacaatagcaaagacttggaaccaacccaaatgtccatcaacgatagactggattaagaaaatgtggcacatatacaccatggaatactatgcagccataaaaaaggatgagttcatgtcttttgtagggacatggatgaagctggaaaccatcattctcagcaaactatcgcaagaacaaaaaaaccaaacactgcatgttctcactcataggtgggaattgaacaatgagaacacttggacacaggaaggggaacatcacacaccagggcctgttgtggggtgggggaagggaggagggaaagcattaggagatatacctaatgtaaatgacaagttaatggatgcagcacaccaacatgacacatgtatacatatgtaacaaacctgcacgttgtgcacatgtaccctagaacttaaagtataataaaaaaataaatttccgattgtttagggatatagaaatacaactggccgggcccagtggctcacgcctgtaatcccagcactttgggaggccgaggcaggtggatcacctgaggtcaggagtttgagatcagcctgaccaacatggagaaaccctgtcgttactaaaaatacaaaattagccaggtgtggtggcacatggctgtaatctcagctacttgggaggctgaggcaggagaatcgcttgaatctgggaggcagaggttatggtgagccgagatcatgccattgcactccagcctgggcaacaagtgtgaaactccatccaaaaaaaaaaaaaaaaaaaaagaaatacaactgattcttacatattgatcttgtatccaaaacaatcttagaaaaggggaacaaagctggagggttcacactttccaattcaaaacttacaaagccatcaagccagaaagtaaattagtggtttccaggggctgggggttggactggggattggaaatactgctaacaggtagagaatttctttctgggaagatggaaatgttctggaggtagtggtgatgattacacaacattgtgaaggtactaaaacccagtgaaccttatactttaaaatggtaaattttatggtctatacatttaatctaaattataaaagctactttgaagaaaacaatgtgattcaccataacagcagattaaagaagaaaaaacatgtaaccacctgaacagatatagaactctaatttgacaacatacaacatcgtttcatgattaaaaatactctcagccgactaggaactaaagggaacttcctcaagctgaaaaagagcatttacaaaaaatctctaccaggcattatacttaaaagtgaaagagaatgcttttcacctaaaattggaaacaagacaagaatatctacttttataattcctatccaacattgtactgaaagacctagccaatgcaataaagcaggaaaaagaagaaaaaaaaatataaagaggaaaggaagaaataaaaccctctctatttgcagatgatacaattgcatggaaaattccaaagaacctataaaaaagctatgataataggttttttcagtaagttctcaggatataggagcaatgtataaaaattagttttatttctataatataattgaacaattggaaatttaaattaaaaagtaccatttacaatagcataaaataccatgaaatatttaggtataaatcaaacgaatcatgtacggtaactttatgctgaaaactacaaaacactaatgagagaaataaaagacctaaataaatggagagagacgctgtggtcatggattcgaatattatagttccaatattgttaagatgtcaattctccctgggttgatctacagattcaatgcagtaaaaatcctggataatattccattgtgcacatgtaccacattttctttatccattcatctgttgatggacacttaagttgattctatatctcgactattgtgaatagtgctgcgataaacacgggagtgcagttatctcttcagtatactgatttcctttcctttggcaatatacccagcactgggattgctggatcatgtggtagttccatttttagttttcttgaggagcctccatattgttctctatagtggctttactaatttacattcctactaacagtgcatgagggttcctctttctctgcatctttgccagcatccatcattgtttgtcttttcgataaaagcccttttaactggaatgagatgatatctcattgtggttttcatttgcatttttctggtacacaaaggaatattattcagccataagatgaatgaatcttgtgatttgcaataacaggattggaactggaggacattatgttaagtaaaacaacccgggcacagaaaaacaaatattgcatgttctcattcatgtgtaggagctaaaaaaaaatggatctcatggaggtagagagtagcatgatgggttactagagactgggaagggtagtaaggaggatggggtaaagaggggatggttaatgggtacaaaaatacagttaggaaaaataagacctagtgtttggtagcacagtagggtgactatagttaacaataatttattgtgtatttcaaaataactacaggaatggaattggaatgttcccagcaaaagaaatgataaatccttgaggcaacggatatcccagttaccctgatttgatcatcacacattgtatgcttgtataaaaatatcacatgttccctataaatatgtgcaattattacatattcataaaaaggtaaaaatcctagaagtatattttgcagaatttagccaattctaaaatttatataaaaaataaaaaagtagagtatccaaaagaattttgaaaagaatcttgatacataccattaagtagctgtcactttttatttatttatttaatttaaaaaaattagattgatattttataatttttcaacttttactttaggtttgagggtacacatgaaagtttgttatataagtaaactcatgtcatgggagtttgttgtacagagtattttgtcacccaggtattaagcctagtatccaatggttattttttctgctcctgcctcctcccaacctccaccctcaagtagaccccagtgtctgttgtttccttctttgtgttcataagttctttatagtttagctcccactaataagtgagaacatgcagtatttgtttttctgttcttgtgttagtttgctaaggataacggccttcagctccatccatgttcccacaaaagacatgatcttgctatttttatggctgcatagtattccacggtgtatatgtaccacattttaaaaaatcctatttgttattggtgggcatttaggttgattccatgttttgctattgtgactagtactgcaataaatattcatgtgcatgtgtctttatggtaggatgatatatattactctgggtatatccccagtaatggggttgctgggttgaatggtagttctgcttttagctctttgaggagttgccatactgctttccccaagtggttaaactaatttaccactcccaccaacagtataagtgttcccttttcttcacaacctcaccagcatctattttttaacttttactaatagccattctaactggtgtgagatggtatctcattgtggttttgatttacatttctctaatgataatgattttgagctttttttgtatgcttgttggctgcatgcatgtcttctttcgaaaagtgtctgttcatttccttttcccaccttttaatggcgttgtttttctcttgtaaatttgtttaagtaccctgtagatgttggatattacacctttgttggatgcatagtttgtgaatattttctctcattctttaggttgtctgttcactctgttgatagtttcttttgctcttgcatttaattagatgccatttgtcaatttttgcttttgttgagattgctttttgtgtctttgtcaggaaatctttgcttattcctgtgtctagaatggtattgcctaggttgtcttccagggttcttatagttttgggttttacatttaagtctttagtctatcttgagttgatttttgtatatggtgtaaggaaggggtccagtttcaatcttctgcatatggctagccagttatcctagcaccatttgttgaataggaattcttttccccattgcttatttttgtcttagatcagatggtcataggtgtatggccttatttctgggctctctattctgttccattggtctatgtgcctgtttttgtaccagtatcatgctgttttggttactgtagccctgtagtatagtttgaagtcaggtaatgtgatgcctccttctgtgttctttttgcttaggattgacttggttattcaggttcttttttgattccatatgaattttaaaatagtttttcctagttctgtgaagaatgtcattggtagcttaatagtaatagcactgaatctataaattgctttgggaagtgtgtccattttaatgatattgattcttcctatccatgagcatgagatgttttaccatttttttggtgtcatctctgatttctttgaacagtgttttacaattctcactgtacagatctttcaactctctggttagctgtattcctagttattttattctttttgtggcaatcgtgaataggattgccttcctgatttggctcccagctcttgttggtgtataggagtgctagtgatttttgtacattgatttcgtatcctgaaactttgttgaagttatttatcagctgaaggagctcctaggccaagactatggggttttctaaatatagaatcatgttgtctgcaaacagggatagtttgacttttttacttcctttcttcctatttgtatgcccttttttctttcttttgcctgattgctctggctagaacttccaataatatgttgaataggactagtgagcaaaggcatccttgttttgtgctggctttcaaggggaatgcttttgcccatcaagtatgatgttggctgtgggtttgttgtagatggctcttattattttgaggtatgttccttcaatacctagtttattgagaatttttaacataaaggggtgttgacttttattaaagccttctcttcatctattgagataatcatgtggtttttgtctttagttctgtttatgtgatgaatcatatttattgatttgcatatgttgaaccaactttgcaccccgggaatgaagcctacctgatcatggtggattagatttttgatgtgctgctggatttggtttgcaggtagtgtgttgaggatttttgcattagtgttcatcaagaatattggcctgaaattttctttttttgttaagctgacactttttagtttgatgccaccccatttgtctggtttgcttttgttgcctgtgcttttggggtcatatccaaaaaatcatttctcagaagcttgattgtcaagaagcttttccctttgttttcttctagtagttttacagtttcaggtcttgtgtttaagtctttaatccattttgagttgattttgtatatggtttgggataaaggtctaatttaatccttttgaatatgaatatccagttctccccacaccatttgttgaagagaatgtcctttctcctttgcatattcttggcacctttattgaagatcaattgaccataaatgcatagttttatttctagcctccctgttctgttccattggttgatgtgtctgtttttatgccaccaccttgctgttatgcttactagagctttcttgacacagtatgttttgagatcaggaattatgatgcctccagtattttttttcttgaggattgctttggctatttagggtcttctgtggttctacataaattttagttttttttctatttttgtaaaaaaatgccattgggattttgataaggattgtactgaatcagaagattgcattaatactccagtccatgaacataggatatctttccatttatttttgtcttgtttaacttccttaatcaatgttttatagttttagtgtacatgtttttcacctctctggttaaatttaagcttaggtattttttttgatgctattgtaaatgagattgtttcttgatttctttttcagatagttcattgttagtgtatagaagcactattgatttttcacattgattttgtaacctgtaactttactgaatttattcattagttctagtagttcttttttggtggagtttttagggttttttaaaaatatatttatatatatatgtttttatatatatatcattttaagtgtaaacagagacaaatttccttttttatatctgatttgggtctctttcatttatttttcttgcctaattgctgtgaccaggacttccagtactatgttacatagaagtagtgagagtgagcattcttgcctttttcctcattttagtggtaaagctttcaatttttcaccattgagtatgatgtttgttgtgggcttgtcgtatatggcctttatcatattgaggtacattccttctgtagcgaatttattgagagtttttattataaaagaatgttgaattttgtcaaatgcttttttttgcgtatattgagatgatcatgtggttttagtccttcattctgttaatgtgatatgccacattaattgatttgcatatgtggaatcatccttgcatctcgcatcccagggataaatcacacttgatcatggttattatctttttatcttttttttttttttttttaacagagtctctctgtgttgcccaggctggagtgcagtggcgttatctcggctcactgcaagctccacctcccaggttcacgccattctcctgcctcagcctcttgagtagctgggactataggcgcccgccaccatgccctgctaatttttttttttttgtatttttagtagagatggggtttcaccatgatttccaggttggtctcgaactcctgacctcaggtgatccacacgccctggcctcccaaaatgctgggattacaggcatgagccactgcatctggccggttatatgactttatatgtttgtcaaaactcataaaactatgtactaaaaggctgaattttattgtatgtaaactcttccccaataaatctgacctaaaaaacaatcaaattctgttgactttaggataaagtattcagttatcaatgagtcttccctcaatggtgtatgaggcagaaatcacgttgcagagccgtggcatgatgtcccctgcacattccctttctagaacttgtcccagtttgaaattgctatacacatctccctgttaatccattgattactctcctctcctccacctggctgcactgagggccctggaaggcactgtatctctattacccagctgtgtgcttagcaataagaaacacttgtttgttgaatgaatgaataaatgaatgaatgaatgtatgattaaataggtgaattttatggatgaattctacatattgaccttgaagatatttcttaatatcacaacaaatattcaaataacaaatagttatttttaatctaagccagttattagccttattagtcagagtgccaactttgactttttacctccctaaagattcccaatatattgaaagggtggtattctgtcttctcttctagaattttctatgtattttccaacccaaattcttctttgctgccttaataatctcccaggaataccacctggagtaaatcctcactcactgcccattgactctactataggcttattttttatcttttaaattattaaaaaatatatatatacacttagagattgggatcttgctctgttgcccaagctggagtgcagtggtgacaaagctcactgcagccttaaactccttggctcaagggatcctcccacttcagccccccgaggagctgggattacaggcagaaaccattctgccaggcttattatataggttcctttagctggcagcacattcaagtgataatttatcatgaaccatatagaagatcacatctgctccagagggattcccccagcaggcataacttttcttcagagagagaaaacctccacatctgctttaggtgggaagaggtgtgtgattacggtcctgtctctttcagatcggcgcctacttcggggcctccctctgctccgtggacgtggacagcaacggcagcaccgacctggtcctcatcggggccccccattactacgagcagacccgagggggccaggtgtccgtgtgccccttgcccaggggggtgagtggcaatgggacctgggctgggtggggcccggtgtgggtggaggggtcgcctgggttggggcctgatactgtttgtgtttagcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccaggtgagacctggtcactgtccttgtcatgacagtagcctctttgttgatctttctcctaattcagtgtgcccacagctgccagataagttctcacagtactcctttcagaaccttcaaaaataataacatgtggctgggcctggtggctgacgcctgtaatcccagcactttggaaggctgagttgggaggattgtttaagcccaggagctcaagaccagtcagggcaacatggtgagaacccatctctccaaaaaaaaaaaaaaaaaaaaaaaattagccaggtgtggtggcatacacccatggtcccagctactctggaggctgaggccggaggattacttgagcctgggaggttgaggctgcagtgagtcctggtcacaccactgtactccagcagccagagtgacagagtcagacttgcacatgcatgcgtgcacgtgcacacacacacacacattcacagaaatctcaaagactcttagttccagattgattatttctacagcaataggaggtgcatgatagcctcatcacccccactttacagatgagtagatcaaggcccagcgatggcaaatggcaagctagcagtattgggatgcaggcattcctttcttctgaatctcggtcctggtaaggtgaccaagagctctagtttgcttaactctgtcccagatttagtactgaaatcccacatcctgggaaacctatgcggttggccaccttacgggattgcacacttcacagatgtggaattgtgcagtcacacgtgcccctctctcagaatcgccctgtgcttggcttaatgctctgctattgccatcttcaattcttagtaatttttcaacaaggggtcctacgtttttttgcattgggtcttgcaaagcatggagcccatcctgatgacttgtcaccctatattctggacctgacaactgttttgctctgtaagttggctttctgtctcctgccaggtggagcccactgtctggagggacccttacagtctggttccatcttccctgttcatattctttcccaccatagccacctgagaccatctagttttctggcctctggtctctgggtttttgctagccttacatttttctttctttatgtttaaaaatttttttattgtggtaagggcacttaacatgagacctatcctcttaacagattttaaaatgtacaatgtaatactgtcatctattggtgcaatgttgtacagcagacctcttgaacttcatcttgcatattgaaaatgtatacccattgattagcaactcctcattgttctctagcctctggcagccaccattatattctttgcttcaatgagtttggctgttttatttttttttagtttttgagacaaaagtttcagtctgtcgcccaggctggagtgcagtggcacaatctcggctcactgcaaccttacctcctgggttcaagcgattctcctctctcagcctcctgagtagctgggattacaagcatgcaccaccatgcctggctaatttttgtattttttgtagagactgggttttgccatgttgtccaggctggtcttgagctcccggactcaagtgatccacctgccttggcctcccaaagtgctgggattacaggtgtgagccaccgcaccctgccagtttggctattttagataactcatataagtgaaaccacgccgtattcatcctttggtgactggcttatttcacttagaataacgtcctccaggttcatccatgttgtcacaaatgaaagaatatctttcttctttttcttctcctcctcctcctcttcctcctcctcctcctccgcctccccctcctcctcctcttcctcctcctccccctcctccccctcctcgtcgtcctcctctcctcctcctcctcctcctccttcttcttttttgacaaagtcttgttctgtcacacaggctggagtgcagtggtgcaaacacggctcctggaagcctcaacctcctgggctcaagcgaccctcccacctcagtctcctgagtagctgggactgtgggcccattccaccatgcctgtctaatttatttttattttttgtagagatggggtctccctatgttgcccaggctgatggctttcttttttaaggctgaataatatcccactgtatgtatataccacaattaaaaaaatccatcatttcctggtagagagggaaggaaaaatccctcatctgttgataggcatttaggttgttttcacatcctggctattgtgaatagtgctgcaatgaacatgggcacgttcatatctctttaagatcataatccccattcctctggttaaataaccagaagtgggattattaaatcatatggtagttctatttctaattttttgaggaacttccatacgttttccctaggagctgcaccattttgcagtctcgccaacagtgtgcaaaggttctgatttttccatgtgtttaccaacacttgtcttttgtttttttggcaatagccaggctagcaggtgtgcaagtgaaatttcactgtggctttgatttgcatttccctgatgattagtgatgttgagcatcttttcatgtatgtattgggcatttttgtgtctgaaaaaaatgtctcttcaagcccttaagcttatttttaaatcaagttattaaggccgggagcagcggctcatgcctgtaatcccagcacattgggaagccgaggcgggtgtatcacctgaggtcaggagttcaagaccagcctggccaacagggtaaaacttcatctctactaaaaatacaaaaattagccgggctgtggtggtgcatgcctgtaatcccagctattccagaggctgagatgggagaatcgcttgaacccgggaggtggaggttgcagtgagccgagattgtgccactgcactccagcctgggagacagagggagaccttgtctcaaaaaaagagaaaagttattagattttttgctattgagttgtatgagttcactatatattttggagattaaccccttatcagatacatggtttgcaaatactctctcccattccataggttatattttactctgcttattcttgcctttgctgtgtagaagtctcacttggtttgatgcagtcaggcttagttatttttgtcgtctgtacttttggtgtcatagccataaactcattgctcaaaccaccatctttccagcttctcccctgagttttattctagatgttttactttttcattgaagtctttaattcattttgaattgatttttgtgtatggtatatgagtcaagttgcattctcctgcatttgtatatccagtttcccaataccatttgtctaagagagtatcctttacccattgtgtattcttggcattatttaggagaatcagttggacccatatggatgggtttatttctgggctctgtattctgttccatttgtctatatgtctatctttatgctagtaccatactattttaagtactataactttgtcatttatatatataatcctgcattttattagagtcaaataacattaaaagaaagacacttatattcgctttagaaaacccattgatgttgatgaatttggcacatacttataaaagcaaggcttattagctcatatatttggaactaaaaagtatttgaagttgatcacagcataatgaatcctcaatttccagagtactagagatgattatatacaaaaatccagtgaaacttattttactaatttaccagttctatatcactcctaaatttccctaaaaatatggatttataaaaggtagtattctataattcacaaatatgaagagctttattataatttgagtatgaactgtgtatcacccatatcatggcttcagaaaactattgcttttcttactaacttatttaaggtttcactacatgagtcagtatgcagaactcactatgttgtaactacgatctgtaatgataaaaatatagaacctctttgactttaatctaaaaaagtcaccttatcataaaacagtgttaacataatcaaaaattaaccctgacaaaaaaaaacccacttattttggcttttaaaaatagctcatgctcatggttctttcaaagtggtgttgtagctaccgtcttttctaacagaggaatattttcatcatagcaactatttctgagccaaaaataaaccacactaaaaacagaagaaaattctcagtgtagaaaggaaaaggctcatctgttgtgcaatagcaggcatcgggctctgtgagtgcctttcagacatcctcaatcaacccaactagaggcactattgagtttatccagtaagagcactgtgcaatctagtgctgtgagggcattacttaattagccaaaggaagaacaatctttttttctttcttttcttttcttttttcttttcttttcttttttctttctttctttctttcttctttctttctttctttctttcttccttcctttctttctttctttctttctttcttttttctttccttctttctttctttcttttttttctttctctttctcttttgtttttgtttttgttttgagacggagtctcgtgctgttgcccaggatggagtgcagtggagtgagctcggctcactgcaacctccgcatcccaggttcaagctattctcttgcctcagcctgccgagtagctgagatgacaggcgcccgccactacgcctggctaatatttttctctttttaggagagacggggtttcaccatgttggccaggctggtctcgaacacctgaccttgtgattcacctgcctcagcctcccaaagtgctgggattacaggcgtgagccaccgcgcccagctttttctttctctttctttcttctttctttctctctctctctttccctccctctttctttctttctctctctctctttccctccctctttctttctttctttctttctttctttctttctttctttctttctttctttctttctttctttctttctttctttctttttctttctctctttctttctctctgtttctttctctctctttttatttttttgagacaaggtctccctctgttgcccaggctggagtgcagtgacgagatcatggctcactgcagtcttgacacccaggctcaagcaattcttccttctcagctgcccaagtagctgagactataggtgtgcacccccacgcttggctaatttttcaattttttgtagagatgaagtctcactatgttggccaggctggtcttctggcctcaagccatcctcctgccttggcctctcaaagtgttaggattatagatgtgagccactgcacccagccaaagcagtcttcaagttatgtaccagtaatttatatagcttttctaaaatttaagaaagtactgaatggactatagttattatctaaaatttaagcaagtactgagtggactatagtcattatatgattttttaaaaaatttcagtaacttttggggtacaagtgctttttggttacatgaatgaattctatagtggtgaattctgagattttagtgcacctgtcatcaaagcagcgtacactgtaccaaatatatagtcttttgtctcttacctcctcccagactccccttccccaagtcctcaaagtccgttacatcactcttgtctttgcatccttatagtttagctcccacttataaatgaaaacatatatttagttttccattcctgtgttacttcagtaatggcctccagttctatccaagttgctgcaaaatacattatttgttcctttttatggctgggtagtactctgtgtatatatacacatatacacacacacatatatataactttttaaaatccactcattggtcgacgggtaccacagtttggttccatatctttgcaattgtgaattgtgctgctataaacatgcatgttcatgtatctttttcatataatgacttcttttcctttgggtagatacccagtagtgggattactgaatcaaatggtagatctactattagttatttaaggaatctccatactgttttccatagaggttgtgctaatttacattcccaccagcagtgtaaaagtgtccccttttcatcacatccatgccagatctattgttttttgactttttagttatggccattcttgcaggagtaaggtggtattttattgtggttttaatttgcatttccttgatgattagtgatgttgagcatttttttcatatgtttatcggccatttgtatatcttcttttgagaattgtctattcatatcctttgcctactttttgatgggattatttgttttttccttgctgatttgtttgagttccttatagtttctggatagtagtcctttgtcagatgcatagttggcaaatattttcttgcattctgtgggttttctgtttgctctgatgattatttcttttgctgtgcagaagctttttagtttaattaggtcccatttattggttttgttgcatttgcttttggggtcttggtcatgaattctttgcctaggccaatgtccagaagagtttttccaatgttatcttgtagaattgttatggtttcaggtcttagatttcagtctttgatccatcttgagttgatttttgtataagttgagagaagaagatccagtttcattcttctacatgtgatttgcctgttttcccagcgccatttactgaatagggtgtccttttcccaatttatgtttttgtatgctttgtaaaagatcagttggctgtaagtatttggttttatttctgggttctttgttttgttccattggtctaagtgcctatttttataccagtaccatgctgttttggtaactatagccttgtagtataatttgaagtctggtactgtgatgcctccagatttgttctttttgcttagtattgctttggctatttgggctctttttttttgttccatatgagttttaggattgttttattctagttatgtgaaaaatgatgttggtattttgatgggaattgcattaaatctgtagattgggcagtatggtcattttcacaatattgattcttcctatccatgagcatgggatatatttccatttgtttgtgtcatctataatttatttcagcagtgttttgtagttttccttgtagggagcttcacctccttggttaactatattcctaggcattttattttatttttgtagctgttataaaaggggttgagttcttgatttgattctcagctttgtcattgttggtgtatagcagtgctactgatttgcatacattgattttgtaacctgagactactgaaattgtttatcagatctaggaatcttttggatgagcctttagcattttctaggtaaatgatcatatcattggcaaacagctctaatttgacttcctcttttccaatttggacccctttatttctttctcttgactgatttgatttggctgggactttcagtactgtgttgaatagaagtgctgaaagtgggcattcttgtcttgttccagttcttagtgagaatgctttcaacttttcccccttcaatatgaagttggctgtgcttttgtcagataatggcttttattattttgagataagtcccttctatgtctaatttattgaaagcctttttttaatcataaagggatgctggattttatcaaatgcttgttctgcatctattgagatgattatatagttttcttctttaattctgtttatgtgatgtatcacatttattgacttgcatatattaaaccattcctgcgtccttgggatgaaacagacttgatcatgatgtattatctttttgatgtactgttggatttggttagctagtattttgttaaggatttttgcttctatattcatcagggatattgttctgtagttttcttttttttgttatatccttttctggttttgatattagtgtgatactggctttatagaatgatttagggaggattccctctttctctatcttttggaatagtatcatatcattggtaccaattctttgaatgtctgttaaaattcagctgtgaaaccttctggtcctgggctctttctgatttgatctcgctgcttgttattggtctgttcttggtatctatttcttgctatagctattatatgattaatccaaggtaccgaaaagcattttgaatgatttagcaggccatcctttttccttgtgtcctaatgaggaatttttttgacgcttcataattctcttaacaaggaattttagctcctcctccatcattttgtaaaataacgatgataatttaaaacttccatcaacatattaaattttcaaaattaaacaactaaaagctacaaaaatctcaaagtttgagttttaaactgaatatttgaagctaatatagaaatttttgataagaatatcagtgcagacatataacactcaaaccttcacagctaatggcaatatctattagcaatgcaaggtactctttttttttttttttctttttgagatggagaattttgccctgttgcccacactggagtacagtggcatgatcttggcttactgcaacctctgcctcctgggcaagagattcttttgcctcagcctcctgagtagctgggattacaggagtgcgccaccatgcccagctaatttttgtatttttagtagagattgggtttcaccatgttggccagtctggtctcgaactactgaccttgtgatctgcccgtctcagcatcccaaagtgctgggattacaggcatgagccaccatgtctggccgcaaagtactcttaatgacttttaaatcatgtttaacagagagtttacacaagttagtccaatgtagttagtattagtgtccaataatatatgaacacccttcaagacaattgctgctacattttcaatataattattaattgttgtctgaaaaacacacataaacgcaagtgagactaaaagttgtgtcacaaaagaaaaaaagaaaagaccagtaccatgctgttttggttactgtagcctggtagtatggtttgaagtcaggtagcgtgatgcctctagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctacccacgagcatggaatgttcttccatttgtttgtatcctcttttatttcattgagcagtggtttgtagttctccttcaagaggtccttcacatcccttgtaagttggattcctatatattttgttctctttgaagcaattgtgaatggaagtgcactcatgatttggctctctgtttgtctgttactggtgtgtaagaatgcttgtgatttttgcacattgattttgtatcctgagactttgctgaagttgcttatcagcttaaggagattttgggctgagacgatggggttttctagatatacagtcatgtcatctgcaaacagggacaatttgacttcctcttttcctaatcgaatgccctttattcccttctgctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcctatcagtacctaatttatggagagtttttagcatgaagggttgttgaattttgtcaaaggccttttctgcatctattgagataatcatgcggttttcgtctttggttctgtttatatgctggattacgtttattgattttcgtatgttgaaccagccttgcatcccagggatgaagcccacttgatcatggtggataagctttttgatgtgttgctggattcggtttgccagtattttattgaggatttttgcataaatgttcatcaaggatattggtctaaaattctctttttttgttgtgtgtctgccaggctttggtctcaggatgatgctggccttataaaatgagttagggaggattccctctttttctattgattggaagagtttcagaaggaatggtaccatctcctccttgtacctctggtagaattcggctgtgaatccatctggtcctggacttttttttggttggtaagctattagttattgcctcaatttcagagtctgttattggtctattcagagattcagcttcttcctggtttagtcttgggagagtgtatgtgtcgaggaatttatccatttcttctagattttctagtttatttgcgtagaggtgtttgtagtatcctctgatggtagtttgtatttctgtgagataggtggtgatatcccctttgtcatttttgtattgcatctatttgattcttctctcttttcttctttattagtcttgctagggctctatcaattttgctgatcttttcaaaaaaaccagctcctggattcactaattttttgaagggttttttgtgtctctatttccttcagttctgctctaatcttagttatttcttgccttctgctagcttttgaatgtgtttgctcttgcttctctagttcttttaattgcgatgttagggtgtcaattttagatctttcctgctttctcttatgggcatttagtgctataaatttccctctacacactactttgaatgtgtcccagagattttggtatgttgtgtctttgttctcattggtttcaaagaacatctttatttctgccttcattttgttatgtacccagtagtccttcaggagcaggttgttcagtttccatgtagttgagcggttttgagtgagtttcttcaccctgagttctagtttgattgcactgtggtccgagagacagtttgttataatttctgttcttttacatttgctgaggagtgctttacttccaactatgtggtcagttttggaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagttcttcttgttgaattgatccctttaccattatgtaatggccttctttgtctcttttgatctttgttggtttaaagactgttttacccgagactaggattgcaacccctgcctttttttgttttccatttgcttggtagatcttcctccatccctttattttgagcctatgtgtgtctctgcacttgagatgggtttcctgaatacagcacactgatgggtcttgactctttatccaatttgccagtctgtgccttttaattggaacattaagcccatttacatttaaggttagtatttttatgtgtgaattagatcctgtcattatgatgttagctggttattttgctcgttagttgatgcagtttcttcttagccttgatggtctttacagtttggcatgtttttgcagtggctggtaccggctgttcctttccatgtttagtgcttccttcaggagctcttttagggcaggcctggtggtgacaaaatctctcagcatttgtttgtctgtaaagtattttatttcttcttcacttatgaagcttagtttggctggatatgaaattctgggttgaaaattctttcctttaagaatgttgaatattggcccccactctcttctggcttgtagagtttctgctgagagagaaagttcgggttacccacaaagggaagcccatcagactagatcagctgccagtctgatgggcttccctttgtgggtaacccaacctttctctctggctgcccttaacattttttccttcatttcaactttggtgaatctgacaattatgtgttttggagttgctcttctcgaggagtatctttgtggcgttctctgtatttcctgaatttgaatgttggcctgccttgctagattggggaagttctcctggataatatcctgcagagtgttttccaacttgattccattctccccgtcactttcaggtacaccaatgagatgtagatttggtcttttcacatagtcccatatttcttggaggctttgttcatttctttttattcttttttctctaaacttctcttcacgcttcatttcattcatttcgtcttccatcgctgataccctttcttccagttgatcgcgtcagttactgaggcttgtgcattcgtcacgtagttctcgtgccgtggttttcagctccatcaggtcctttaaggacttctccgcattgattattctagttatccattcgtctaattttttttcaaagtttttaacttctttgccattggtttgaacttcctcctttagctcagagtagtttgatcttctgaagccttcctctctcaactcgtcaaagtgattctccgtccagctttgttccgttgctggtgaggagctgcgttcctttgtaggaggagaggcgctctgatttttagagtttccggtttttctgctctgttttttccccatctttgtggttttatctacctttggtctttgatgatggtgacgtacagatgggtttttggtgtggatgtcctttctgttgttagttttccttctaacagtcaggaccttcagctgctggagatatagaccaatggaacagaactgagcactcagaaatagtgccgcatatctacaactatctgatctttgacaaacctgacaaaaagaagaaatggggaaaggattccctatttaataaatggtgctgggaaaactggctggccatatgtagaaagctgaaactggatcccttccttacaccgtatacaaaaattaattcaagatggattaaagacttacatgttagtcctaaaaccataaaaaccctagaagaaaacctaggcaataccattgaggacataggcatgggcaaggacttcatgtctaaaacatcgaaagcaatggcaacaaaagccaaaattgacaaatgggatctaattaaactaaagagctgctgcacagcaaaagaaactaccatcagagtgaacaggcaacctactgaatgggagaaaatttttgcaacctactcatctgacaaaggggtaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacagcaggtgttggagaggatgtggagaaataggaacacttttacactgttggtgggactgtaaactagttcaaccattgtggaagtcagtgtggtgattcctcagggatctagaactggaaataccatctgacccagccatcccattactgggtatatacccaaaggattatacatcatgctgctataaaggcacatgcatacaagtgtttattgcggcactattcacaatagcaaagacttggaaccaacccaaatgttcaacaatgatagactggattaagaaagtgtggcacatatacaccatggaacactacgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacaaacctgcacgttgtgcatgtgtaccctaaaacttaaagtattataataataaaaaagaaaaagaaaagaaatccaatgaatcaattaatgctatcaacaaagaacatgcaagaatgtaacattacatgtaatttttgttttcaaaaaagacactaaaatgccactgcattaaaatgtatttattatttattattattatttttgagacagggtcttggtctgtcatgcaggctggagtgaagtggtgcaatcatggctcactgcagccttgacctcccaggctcatgtgatccgcctgcctcagcctcctaagtgtctttgactgcaggtgtatgccaccatacctggctaatatttaaatttcttttgcagtgacagggtctgtctatgtttcccaggctggtctccaactcctgggctcaagtgatcttcccaccttggcctcccaaagtgctgggactactggtgtgagccactgcactcagccggactataatttattcagaacatctttagtgttcattcccagagatcttgatctgctcagtaatgctttcacaagatcgattatagccatcttttgcagtgaatgcttaggctggtccgtcctcctgtggtagtagggagcagtctttttttttttttttttaaatcttcatgtttttatttattttttcttttttaaattacacattgggccaggcacagtggctcatgcctgtaatcccagcactttgggaggccgaggcgggcggatcacgaggtcaggagttcaagaccagccttgccaacatggtgaaaccccatctctactaaaaatacaaaaattagctgggcttggtggcgtgtgcctgtaatcccagctacttgggaggctgaggcaggagaattgcttgaacccaggaggcggaggttgcagtgagccaagactgcaccactgcacgccagcctggcaacagagcgagactccgtctcaaaaaaaaaaattatacgttaagttctgtgatacatgtgcagaacatgtaggtttgttacctaggtatacaagtgccatggtggtttgctgcacccatcaacccgttgtctaggttttaagcctcacatgcattaggtatttgtcctaatgctctccctcccccttgatccccacccctcaacaggctccagtgatgttcccctccctgtgtccatgtattctcattgttcaactcccacttatgagtgagagtatgtggtgtttgctttcctgttcctgtgttagtttgctgagaatgatggtttccagtttcatctatgtccctgcaaaggacatgaactcattctcttttatggctgcatagtattccatggtgtatatgtaccacattttctttatacagtttatcattgatgggcatttaggttggttccaagtctttgctattgtaaatagtgcttcagtaaaaatacatgtgcatgtgtctttatagtagaatgatttataatcctttgggtatatacccagtaatgggattgctgggtcaaatggtatttctggttttagatccttgaggaatcgccacactgtcttctacaatggttgaactgatttacactcccactaacagtgtaaaagcattcttatttctccacatcctctccagcatctgttgtttcctgactttttaatgatcatcattttaactggcatgagatggtatctcattgtggttttgatttgcatttctctaatgaccagtgatgagcttttttttttcatatgtttgttggccacataaatgtcttcttttgagaagtatctgttcatatcctttgcccattttttgatggggttgtttgtttttttcttgtaaatttgtttatgttccttgtagattctggatattagacctttgtcagatggatagattgcaaaaatattctctcattctgtaggctgcctgttcactctgatgatagtttcttttgctgtgcagaagctctttagtttaattagatctcatttgtcaattttggcttttgttgcaattgcttttggtgttttagtaaggaagattttgcccatgcctatgccctgaatggtactgcctaggttttattctagggtttttatggttgtaaattttacatttaagtctttaatccatcttaagttaatttttatataaggtgtaaggaagggatctagtttcagttttttgcatatggctagccagttttcccagaagcatttattaaatagggaatcctttccccatttcctgcttttgtcaggtttgttgaagatcagatggttgtagatgtgtggtgatatttctgaggcctctgttctgtttcatttgtctatatatctgttttggtatcagtaccatgctgttttggttactgtagccttgtagtatagtttgaagtcaggtagtgtgatgcttccagctttgttgttttgcttaggattgtcttggctatatgggctcttttttggctgcatatgaaatttaaagtagttttcacaagatcagctacagccaacttttacagcaaacggttaggctgttcctcctgtggtagtaggaggcagggtttttttttttttttttttgagatggagtctcagtctgtcacccaggctggagtacagtagcgtgaactgcaacctctgcctccaggttcaggtgattctcctgcctcagcctcctgagtagctgggattacaggtgcccaccaccacacccagctaatttttgtatttttagtagagatggcatttcaccatgttggccaggctggtctcaaactcctgatctcaagtgattcacctgcctcagcctcccaaagtgctgggattacaggtgtgagtcaccgaacccggccctctttgcccatttttaaattgggttatttattttcttactattgagttctttatgtgttatggatattaaccatttatcagttgtgtggtttgcaaatattttcccccagtctgtaggttgtctcttcactctgttaattattcctttattgtgcagaagctttttagtttgatgcaattccatttgtctgtttttgtttttgttgcttgtgctttcaggatcatataaaaaaatcattgcccagaccaatgtcatgaagctttccctctacgtttccttctaatagtttatagtgttagatcttacatttaagcctttaactcactttttaatttttttattttttaatttaattttattttagatggagtctctctctattgcccaggctggagtgcagtggcacgatctcagctcactgcaacctccacctcccgggtcccagcgattctcctgcctcagcctcccaagtagctgggattacaggcctccgccaccatgcctggctacttttttgtatatttaatagagacggggtttcaccatgttggccaggctggtcttgaactcctgatctaaggtaatccacccgcctcagtctcctaaagtgctgggattacaggcgtgagccactgcacccggcccagcacttttgatttttgtatttggtttgagataaaggctcagtttcattcttttgcctgtggatatccagtgttcttaacaccatttgttaaaaagactgtcctttccccattgtatgcccttggcacctttgttgaaaattagttgattgttggccgggcgcggtggctcatgcctgtaatctcagcactttggaaggctgaggcgggtggatcatgaggtcaggaaatcgagaccgtcatggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagtcgagattgcgccactgcagtccgcagtccggcctgggcgacagagcgagactccgtctcaaaaaaaaaaaaaaaaaaaaaaaaaaaaaaaaaaaaaattagccaggcatggtggtgggcacctgtagttccagctactcgggaggctgaggcaggagaatgggggaacctgggaggaagaggttgcagtgagcctacatcatgccactgcactccagcctgggtaacagagcaagactccgtctggaaaaaaaaaaaaaagaaaagaaaattagttgattgtaaatgcatgggttcatttctgagctctgtattctgttccattggtcaatgtctctgtttttatgtcagtgtcatgctgttttgctgagtatacctttgtggtgtattttgatgtcaggtagtgtgatacctctacctttgttgtttatgctcaagattgtcttggatatttgaggtcttttgtgacttcatattaattttagtattgttttttctatttctgtaagaaatgccattgggattttggtaggaattacattgactctatcgatcactttgaatagtatggacctttaaaaatattctttcaatccataatatgggatatctttccattgatttttgtcttaactttctttcgtcaatgttttatagttttagtgtgcatatttttcaccttcttggttaaattaacttgtaagcattttattttttgatgccattgtaaataggattaatttctttttcagatagtttgttgttagtgtatagaaacaaataatttttgtatgttcattttgtattccatgactttactaaatttgtttattaaatttgataactttttcgtagagtatttataacaagtttcttatatataagatcatgtcaattgcaaacagggacaatttttttttctttatttctaacttgaatgcatttcttatctttttcttgcccaattgctctggctaggactttcagtactgtgttgaaatagaagtggtgagtgtgggcatccttgccttgttcctaattttagtggtaaaatcaaattttcaccactgggtatgatgttaactagacactttttttaatgttctttatcatgttgatgtaatttccctgtatttctagtttgttgagggtttttaatcatgagtggctattcctgtggcctgaatgtttgtgtcctccccagattcatatgttgaagcctaattccttgtgtgatggtatttgtagatgggacctttggaaggtgtttaggtcatgagagtgtggccatcattaataggattagtgcccttagacaaaagcaaaatgatggttgcctatgaaccagaaaataggctctcaccagatattgaatctgcttgcaccttgattttggatgtcacaagtcttcagaactatgagaaataaatttctattgcttataacccatccagtctatgttatttgttataccaaataagctaagacagatgtttagttttattaaatgctttcttttcttattgataagatcatgttatttttattccttattctgttaatgtggtgcatcacatttattgatttgcatatgttgagccatccttgcatgccaggaataaagcccacatggtcatggcgtatgacccttttgtgctattgaattcagtttgctagtattttatttaggattttggatctatgttcaatagggaaattggcatgtagtgatcttttctcatggtgtgtttgttgggatttagtgtcaggatagtgcttgcctcatacaataagtttggaagtattccctcctcttcagttttttggatgagtttgagaagaattcatattaattcttatttaaatgtttggttggtagaatttgcctgagaagccaccaggtcctgggcttttctttgttaggaggtctttgattactgattcaatttccttactcattatagatctgtttaaactttctattgccttatgattcaggcttggtaggttgtatatttctaggaatttatccattccttcaaggttatcaagtttgttaacatataattgttcatagtagtctcttaatgatcctttttattgctatggcatcagttgtatgttctttcatttataattttacttatctgttgtttctgttttttctccctttttccttggtctacctaaaagcttgtcagttctttttttttttttttttgagatggagtctcactctgttgcccaggctggagtgcagtggcatgatcacagctcactgcattctccacctcccaggttcaagtgattctcctgcctcaggctcctgagtagctggcattacaagcacgtgccaccacacctggctgattttcgtatttttagtagagacagggtttcaccatgatggccaggctggttttgaactcctcatctcaggtgatccacttgcctcgacatcccaaagtgctgggattgcaggcgtgagccactgcacctggccaaagcttgtcaattctatctttttgaaaaatcaacttaatttcattgatttttttctattctctatttgatttatttttctgtaatctttattattttcttccttctactaactttaggtttagtttgttcttttatttctcatttcttgaggtgtaaagttaggttttgtaattgaaatttgtctttttgttttaaaattaggtgtttatcccgaactttcctttagtactgcttttgctgcctcccattaagtttggtatattgtgtttttgttttcatttatctcatgttattttctaatttatttttttatccattagttgttcaatggtgtattgtttaatttttacatatgtatgtttttttccagtttttcttctggtattgtttttagtttcattccattgtggttggaaaagattcttgatataatttaaatcatttcaaatttgttaagacttgttttgtgacctaacatgtggtctgtcctggggaatggtccatgtgcacttgagaagaatgtatattctgcagtagttggcttgtgtattttgtatatgtctgttaagtccatttggtccattctcccttgggttttttttttgtctagttgttctatttgctattgaaagtaggattttgaagtttcttactattgaattgctgtctatttctcccttcagttctgtcattattagctttatatattcagatgtctgatgggtgtgtatataattaattgttgtaactcctggtgaaatggccatttcatcattatataatatcattatttgttttttgacttaaagtctattttgtctgatattagcatgtcatcctgctctcttttggttaccattttaatggaatagcattttctactcctttacttttagcctatgtgtcagtaaatacaaagtgggtatcttgtagatagcatataattggattttgtatttttattaattctgccactctgttttgagagtttgcttctgtttacatttaaagtaattattgatagagaaggatttactactgccattttgttaattgttttctgttagtcatgtaggtcttttgtccctcttttcttctcttgctgtcttcctttgtgttttattgttgttaatttttgtattaatatgctttcattttgttctctttttgtacttttttttttttgagacggaatctcattctgtcacccaggctggagtgcagtggtgcgatctcggctcactgcaagctccgcctcccgggttcaggccattcttctgcctcagcctcccgagtagctgggactacaggtgcccaccacctctcctggctaattttttgtatttttaatagagatggggtttcaccacgttagccaggatggtcttgatctcctgacctcgtgatccgcccacctcagcctcccaaagtgctgggattacaggtgtaagccacgtgagccaccgcgtctgaccctttttttgtgtatataacttctaaaggtattttctttgtggtttccacaaaacatctcataattatcatggtctattttaagctgataacaactgaacttaaatcacatgcactctatacttttattccccactacacgttttacgttattgattcacaatttacagttatttatattgtgtatccagtaacataattttagctatagttatttttaatatctttgtcttataacttttataccataattaaaagtgtccaattcacttgcattaaggacatgacaaaatcacttttaaaatttctttaaaatttattatttggctgtcatttttttcaatattactcttgcacatactttaaagagtcaaaatagttccaaaaagctcactattaaaaaacaacaatttccacatacacgatggttttggcttcatttcccttgctcttgagggaaccactttcagctctttcaattctctatttgttccaattacataataataattttgctactttttgatttttgttttaccactgacttcccaccatggaaggtggagattgatctctttttcagttttccttttgccacatagtagcactcttttaccccccattcacgcctcatgtttatgtgatcattttgtttagatcaacattcagtgtttgcattattctgactacgtaaatgaaattcagctgagccaaataatatacttttacttttccctgtatgcagggaaatgcaggtaattaatagaaattggggttgggcgtggcggctcacacctataatcctagcacttgagaggctgacagggcagaatcgcttgagcccaggagttcaagaccagcctgggccacaaagtgagacccccgtttttattttaaaagtttttttaaaaaagaaattgtaggtatcctcttgaggttgtggtctaaaggtgaataattccttgataagttctaagctgtcctagttccttggttagttgcaagagatgagacttgagtagagcttagagaacctctgtctgggccatgctggatgactgagttatacatctcctgtctttcctacccctttctctctccacacctcttttttaccctcagcggatagcaggctccaagctctctcccaggctccagtattttggtcagtcactgagtgggggccaggacctcacaatggatggactggtagacctgactgtaggagcccaggggcacgtgctgctgctcaggtgagaatgccttttggagtcaaccggacattctcccttgaaggaatgtttcctgtttgaaggtccctgatggttttctggtgtccctttaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggtgaggcttggtggatgagtctcaagaggttaaacgaccgaggacatgaatgggtgctgcaatccactctgcccagccttctggctgtcctgaactgagttctcacaggctctgacaaccttctccaagccttacctgagtgagcaggctattgtcctgctgggtagggaagtccagtggacctccctaaagaggtgagcatgtggcacttccttactcactcagttctccagagaactgaaggccccatgcctgtgaacaaactatgtttttgttttttaataaacggagagaaaacctatttggggagattgaattgatgaagctaaacagagatttacaaagcactcacatacgcattttatcaccagtgacttcttcccttgttcctattctcaaagagtagaactgtgtttggggtgggagaatagtaatgacaatactaagaataactgtctctagtagtgacagcactaggaataactgtctctagtaatgacagtactagaaagaattgtaccctctttaaaagtaaaattattagctaggcatgatggcatgttcttgtagtctcagctacttgagaggctgaggtgggaggggaggatcacttgagcccaggaggttgaggccagcctgggcaacatagcaagacccatccctaaaaaatgattacctttctaggaacagttttcctgtgctgaggagatagcattccagatatgagagcagccagcatggctagaaattaagagcaaaatgttagagagtagggaattgaagaagaggtacccttaaacctacatagaagtccccctctactctttggctgactcttaagacacgaatgcctaggtcagtactccaagacacccagtagaaaacagcaactgaaaagccaaagagctgatcagagaattcagcagctcctcagtgctggggagacagagatttgagaggccttggtaaataccttggtctttccattgagacaactgactagcaaccaagagaaacaatatacaatagaaatagacccacaggtgattcagaaattagagtgattggataggaatttttaaaaggtaactataattaatatcttcaagaaaaaagggaaaggatgagaacttcagcaaaaacctggaattcataaaatagagtcaaatggaaactctagaaccaaaaatcgcactgactgaaatgaagaattcagtaaatagatttatagcagattagaagcagaacagagaattagtgaacaagaagacagtcatttgaaagtatctggataaatatgcgataaaaagaaagaaaaatacagaaaaacaccataagagatgtgtgggatatggtgaaagatctaacaaacatgtaattggaattacagaaagtggtggtgggggaggagagagagagagagagaaagaaaataggaaagatggaataggaaagacagaataggaaagatggaataggatggaataggaaagatgcagtagttaaagaatttccccaaactggccagtcacggtggctcacgcctgtaatcccagcactttgggaggccgaggcaggtggatcacctgaggtcaggagtttgagaccagcctggccaacatggtgaaaccccatctctactaaaaatacaaaattagcaggtgtggtggtatgcgtctgtaatcccagctactcaggaggctgaagcaggagaattgaacctgggaggcggatgttgcagtgagctgagatcgccccattgcactccagtctgggtgacaagagcgaaactccatttcaaaaaaaaaaaaaaaaattccccaaactgatgaaagacatcaagattctttacaaaatcaaagcaggataaatatgaaggacattatatcattgtacgttataatcaaactgctgaagaccaaagacaaagagaaaaaaatttaaagtagtcagaaaaatacaataaattttttagtgagtgacagaatagctaccatttattgagcacttattgtataaaagacactgtgctaaatacttgataagcactatttcatttcctttttaccattgggagggtatcattattatcctcactttaaaaataaagaatggaggccaggcgcagtggctcatgcctttaatcctagcgctttgggaggctgaggcaggtggattactttgagaccagcctggctaacatggtgaaaccccatctctactaaaaatacaaaaattagcacggcgtggtggcatgtgcctataatcccagctacttgggaggctgaggcaggagaaacgcttgaacctgggaggcagaggttgcagtgagctgagatggcaccactgcactccagcctgggcaagagagtgagattctgtctcaaaaaagaaaataaaaaataaaaagaaaggaaggaaggaagaagggaaggaaggaaaggaaggaaagtaggaaaggaaggaaaggaagaaaaggaaggaaggaagaagggaaggaaggaaaggaaggaaagtaggaaaggaaggaaaggaagaaaaggaaggaaggaaaggaaaggaaaaaaggaaggaaggaaggaaagggaggaagagagcgaggaaagaaagaaagaaagaaaaaggaaggaaggaaggaaagaagactcagagaagtcagataacataccccaagtcacacagctgagaagcagaggagctgggccttgaactcccatctgccgggttccgaggctcaggcccctcactgctgtgccaccctgtcccttcaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccggtgagcaggctagtggccagacccctgggtcttccaagcatggagtgggcttggggagctgaggagggcagatccccaaatcccggctatctcttagaattgcatcgaggacccagtgagccccattgtgctgcgcctgaacttctctctggtgggaacgccattgtctgctttcgggaacctccggccagtgctggcggaggatgctcagagactcttcacagccttggtgagtccagagttggggtcctgcaggggtgtggaagagaccagagaccaaggtggttgaaactcattttatttgattgcatctaattttacttcaacatttgattttattgtttaatttcacaatacttggttattttctttcctttcatttgatcatatttattttttaaaagtttccctttgagaagaattgtggcaatgacaacatctgccaggatgacctcagcatcaccttcagtttcatgaggtgagtttcctttcctcctcacctcctccagagaaggacccgtaccatgacccgctcttttctcctcctggcccccaagggagccgggtgttcctgggctataaggtccggtgtggctgcccctccactgttgtctcttcatcaagtgtctgcgtctctgttctgctggagcaggcttgccacagggaagcccagcgccccatcccccggcctgtcttcttcttcccacagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccaggtagccacatccttctcaggctctatctgacctttgcttccccatcctcacggccggaggtggatatcaccgcctttgcctcccctgccttccagaaccagcgctcacagcgatcctggcgcctggcctgtgagtctgcctcctccaccgaagtgtctggggccttgaagagcaccagctgcagcataaaccaccccatcttcccggaaaactcagaggtcagaactcctggctcctcccctccttttctctttgatttctttggggattcttttcttcttcttctcttctttagtagtggttcctttttgtacaaaacagctttattgagatataattcatataccatccaattcacctatttaaagcatacatttcaagcccggcacagtggctcatgcttgtaatcatagcactttaggaggtcgaggcaggaggatcgcttgagcccgagagtttgaaaccagcctgggtgacacggcgagaccctgtctctacaaaaaatgtaaaaattagctgggcgtggtggtgcacacctgtagtcccagctactcgggaggctagggtgggaggatcgtctgggcctgggaggttgaggctgcagtgagctatgatcacaccactgcactctagcctaggcgacagagtgagaccctgtcttgaaaataaataaaatgaaataaaataaaataaagtatacagttcagtggctttgagtgaattcatagggtcttgcatccgtcatcatgatccattttggaacatcttcattacctcacaaagagcttctgttcccgttggccctcagccccagtcctcccatatcccccagccctatgcaaccactaatctactttgtctatagatttgcctattctggacatttcatataaatgaaataatcccgtatgtgatcctttccctagcataatattaagcaaggacttagcaaggatcattcatgtcgtagtatatgtcagtacctcattgctttaaaaaaattgtttttaaattttttatatatatttttgagatggagtttcacttcgttgcccaggctggagtgcagtggtgcaatcttggctcactgcaacctctgcctcccaggtttaagcaattcttgtgcctcactctcccaagtagctggggttacatgcgcccgccaccacacccagctaatttttgtatttttagtagatacagggttttgccatgttggccaggctggtctcgaactcctgacctcaggtgatccacctgcctcagcctcccaaagtgctgggattacaggtgtgagccaccgcacctggccttcattgctttttatttggtgaacaatatcctgttgcatggatgggccatatttcatgtctccattaatcagatgacgggcatttgggttattttttctctcatatttctgtcattgtctctcctttctctcactccaggtcacctttaatatcacgtttgatgtagactctaaggcttcccttggaaacaaactgctcctcaaggccaatgtgaccaggtgctctctgctaccaggcttctgcaggcagttgcccgtctgacgccccagcccctggcccatggtgggcctttgccctttgcccactggttctcccttcaactcatttgttcactcagcaaacactcactgaccacccaccacgtgctgggccttgtgctgagtgctggtgggatggtggtggatcagacgatagtggttcctgccctctcggagatgataatttagtggcaaagacagacaagaaatctagccattaatcttgcatccatctcaaatccagtatgagatgcaagattagatgggggacggccagtgttcttgggagtttggtgttcagagaagattcctaaagaaaatatatttaggagctgggcgtgctggctcaagcctgtaatcccagcactttgggaggctgaggcaaaacaattgctcgaacccaggagttcaaaatcagcctggacaacatatcaataccctgtttctacaaaaaaaaaaaaatacaaaaattagccaggcatggtggtgcatgcctgtaatcccagctactcaggaggctgaggcacaagaattgcttgagcctggaagattgaggctgcagtgagctgagatggtgccactgcactccagcctgggcaatagagtgagacccagtgtcaaaataataataataataataataataaaaaataaaagggaaaaaaagaaaatatatttagacaaagcaaaggcatgaactgagggcgggcatgaagacagaaggcaggaagcagataccagggacgggaagatcagggtgtgtttaagagtggcctcagcatgaaatgcagggctgaaggagttggtggtggttagatacaggccatgtcccaaaatgactgacgggtgttgtttgggatttgcagtttcgcctctgggagtgacataatcatatttgcatgttagaacgatcactcttcaggagggctggcgattggggtgggagcaggtgtgaattcaggggaccagttagaagaaggtggttgcagacatccagctggagagggatgggcctgggctaggcgggggcaggggttggagaacagtggggtttcagatgcagagataacagaacttggtggctgattggaggcagggagtgagggagagggaggagcaaagactaactgtcagttctcaagagccggctggagctctttctttccctccagtgagaacaacatgcccagaaccaacaaaaccgaattccaactggagctgccggtgaaatatgctgtctacatggtggtcaccaggtgctggcttccaggactttagctgagcctccacttctgggctggacatggctgattgtgcatctgtgtgcatgagtctgtgcatgtgtgtgtgtgtgagagtctgaggatctctgtgcatgtatgtgtgcatgggtgtgtatttgggcatgggtgtgtgagtgtgatgatctatgtgcatgtttgtgtgcatggacgtgtatttgtgcatgtgtgtgtctgaggatgtatctgcatgtgtgtatgtgtgcatgggcgtgtatttgtggatgtgagtgtgatctatgtgtgtgtgcgtgcatgggtgtgtatttgtgcgtgtgtgtgaggatccttgtgcatgggtgtgtatttgtgcatgtgtgtgtgaggatctatgtgcatgtgtgtctgggcatgggtgtgtgtgcatatgtgtgtgtctgaggatatatgtgcattgtgtgcatgggtgtgtatttgtgcatgtgtgtgtatgaggatctgtgtgcctgggtgtgtatttgtgcgtatgtctgaaggtctatgtgcatgcgtgtgcgcatgggtgtgtatttgtgcatgtgtgtgtgtgaaggtctatgtgcatgtgtgtgcgcatgggtgtgtatttgtgcatgtgtgtgagggtctatgtgcatgtatgtgtgcatgagtgtgtattcgtgcatgtgtgtgtgtctgaggatctatgtgcatgtatgtgtgcatgggtgtgtatttgtgcgtgtgtgtgtctgagggtctgtgtgcatgtgtgtatgtgctcatgggtgtgcatttgtgcacgtgtgtgtgagtggcccaaatgggcacgcactgtgtgtccagcacacattggttcccccatccccctgcaccccaccccatctccaccccccaggacttcatacccattacccatgtgcctgttcgctccttacacacttagcctgagacaccctcccagggcacccctcatgttttgtcacctcctgtcccttttttctcccttcagccatggggtctccactaaatatctcaacttcacggcctcagagaataccagtcgggtcatgcagcatcaatatcaggtgggcagctgggacgtctgggtcctgagaaggaggctggggaggaaaatcgatggtagaaaatgcagaaacagggatgggaaatgtgcgcaaggcacctgtggtgtgccaggcttggttccacgctgctatcactcagtatgcacacatacacgcacgtatgtatgtgacatgcacgcacgtagttatcttgtattaccttcgtagcgactctgtggggcactgtcatgatccccagtttacagatgaagaaactgaggctcagagaggtttacagaacaagctcgaggtctcccaccgagtaagtgggagagctaggactggagaccaggccgtgtggcactggaatgcgtattacatgtacactctactctctcaaacaggaaggggcaggacgcccgggcctatggcctgccccgtggggaggggaggctgattctccaggctggtgggggaggaaggccagagccctgaccccgccctccccggtgcaggtcagcaacctggggcagaggagcctccccatcagcctggtgttcttggtgcccgtccggctgaaccagactgtcatatgggaccgcccccaggtcaccttctccgaggtgagcggagctcggcctgactcctgcacggccctgcgcgttcctctcacctctgttaatgctattgggttttagagccgctccgcccctctcctggacccaggccatctcacctcccgagatgaggccctggcgccttcatctctgccccttctcagtgcgtctctttcctcagaacctctcgagtacgtgccacaccaaggagcgcttgccctctcactccgactttctggctgagcttcggaaggcccccgtggtggtgagaagctaagtcagccccagggccacacagagacccagagcgcttccctgctggaacctgtatggtctctgagcaaacggggaggggtgttctctgccttcggcttccttacccgtcccctcccctcctgcgttccccagaactgctccatcgctgtctgccagagaatccagtgtgacatcccgttctttggcatccaggaagaattcaatgctaccctcaaaggcaacctctcgtttgactggtacatcaaggtgtgtggggtcctgaggcttcgccgggcacaggcgtggtgctcagggcccaggtgcagtgcccacccgctctcttccacagacctcgcataaccacctcctgatcgtgagcacagctgagatcttgtttaacgattccgtgttcaccctgctgccgggacagggggcgtttgtgaggtcccaggtacctgtcttgggcgctgaggaactattggagggagaggggctgcgcttgtggagatttctgggggaggagagagagacacaaagagagagggagagagagagacagagcgacagagagacagagagatacagagacgtaaggagagagacagacagagacagagagatagaggcagagggagaaacagacacagagacagacaaaggagagagagatagagagtcagagagatagagatagagacagagacagtgagagatggagatagacagagagatagagataaagagagagatacagagcgcgacagagacagagacagtgagccatggagatagagagacagagagaggcagaaagcgatagagagagatagaggacagagaaacggaggagggagaggagggagaagaggtgggggaggaggactgagggctggggttctgggggacatgaggaggggttccccacttgattcaggggtgcacacggtgtgaatggggaacccccagaaatccagagtcgtctcccctgacgcccctccttcctcccccagacggagaccaaagtggagccgttcgaggtccccaaccccctgccgctcatcgtgggcagctctgtcgggggactgctgctcctggccctcatcaccgccgcgctgtacaaggtgctccccgctgctcccccaccccctcccttcatcctctcgggcctcgcgctgcagctccgtgcctcggtttccccggcggggctgccagctgtgtgactggggcgagtctgggagcctctctgcgcctcagtctcttagggagggtggccgggttcatgcgcggggcgcgctgagaacgagtcgccctccttgtagtttctgtttttctccaggccccgacgcggatgtcactcccctcccgccccgccctcctgggtcccttctgtctctgccggccctcccgccccctccccctggtctgcggagccgcacgctccctggctgctgtcgctctcactgccctcctctgccccgcagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcaagtgtctgtgtgcaagtgtgtgcacatgtgtgcgtgtgcgtgcatgtgcacttgcacgcccatgtgtgagtgtgtgcaagtatgtgagtgtgtccaagtgtgtgtgcgtgtgtccatgtgtgtgcaagtgtgtgcatgtgtgcgagtgtgtgcatgtgtgtgctcaggggcgtgtggctcacgtgtgtgactcagatgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggaacctcctccacaccagcgctgatgcccaataaagatgcccactgaggaatgatgaagcttcctttctggattcatttattatttcaatgtgactttaattttttggatggataagcttgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcatatatgtaaggataa

SEQ ID NO: 2519 - DNA, 72927 bp, Homo sapiens; identical to SEQ ID NO: 2518

SEQ ID NO: 2520 - DNA, 162398 bp, Homo sapiens
tttggttttagtcagttctcttcttgtttttatttaatgccataatattatattagcatatgccgtaacatttaaaaatgcccattctctccagcttcagttcaagcaggagtggggaaggccatagactaagcccaccttcaaggtcacacttccatattttgcacagagaagaaaatgcagtctcccatccagatcctcagacccacacaccagcccaccactctcattccagatgccctaagcctgggtctggacacatgtggtcaatacacatcctggatcttacaaatccaatggtggccagcagtagaactgaagcctgtaagttttcattcactcctaaagtgtgctgagaaatcctagcctgttttttccatttaattcctgtagatgagtcatttgctcctcagttttctatggcccaattttcccattggaataatgggaataatatgtcatccaccttacagggtgatgactaatatattggcatttgagatccttagatgaaaggtattactgtgtataagtataaagtactattatttagtaatcactgagttggtaaatgtattcattcatatggagtttttggaggaagagctttaaggaatgacagcagtagaaatgcagctagatatatttttgaaaacattttttaggtctaccaacttagaaaaagtcccagatattacatactccttctaaagcacctaatttgcatttttattattattattatttacctagaactacagaaaaatttatgggaaggaaagtaagggtacagggttttcaacttggggaaattcatttcccatcccctggctgccaagccttcctactcacaattccacaaatgtgcctgcagctgtgaggacagctggagagatctgttgtctttctggtcacctctgacattttgcagtgtctcttctgattgacactgtatacagggcatgacctctctgacttggccctgcctattatgaaagtgtcaccatgggggcagggagctagagagatttagttggtttaaagaagtataatgtgtccttgagctttgagcacagcaatggaaacctggcgactcttcctggagctctagggacttctaaccagagcaagttggttcattacaagctgtcacaccacagaaagagaagacctttggctaaggtagagaaaggctgactcatacaggcagttgtataactgtagacaggcagggcccatggagctgtggagagttcactgggactcctctgccttctaagacacaggttcccacctgcttcagggagagagacttcccactagtccaccttctgtgtgtgttaccaaaaggaagccatatttggagctggtctaagctccagcccctgcaatttcatttgcctttccttagtaaggaacacagtaacaacgcgaacaaaaccacacagagcatgtgaagaccgggcccttctgatgctgatgtgtggagaaaactgggcactagactgaacaaatttttagctattgccttatgggaaccacagaaatggattgaaataaaacttacaaaatcactttaaccactcttatttatgcattaccaccaagggaaaacaaagtcactgaaacagaaaaatgttttccaaaggaaaaatgtttcctctttggtgacctgagaaagtttaccgtaactccattcaaaaccttcaggcacttgacttttttttttttttttaatatcctttacctttttaataaaaagtaaaaaacaaacaaaaaatacatcaatgttccgaatagaacctctctatgtaaaggtctcactaaacaaataaacataggaccagacaaaagaaatggagctgtgaatagcaatatgatatattatgaagcatttatatatgtatgtatatattatatatgaatgtgcgggtatatgtgtgtgcacctatgtatgtataaatctgtaaatatttgcctacatacacgtcacacacacacatacatatttatactgacctctttagattgaagtccaaggcactttttacaatgaacaggttaaagccattaatttagaacataactgtttctgggtacatatcgagttatggcgccaatatcagaattcacgtctttccttgcccaccttggagtgtttcttgttggtgcaatgagtaagagaattggctttcaaggagattagcaatgtttctagatggttaaactaacttctcttgctattttcctctaggggaggggagttcttactggtgagatgctgagttcctcaagggaagaacacaaggatcgagaaacacaacaatttctgtactatgctaagcagagactcctgtagccttccagaggacctgccctgaggttccacctgatattctgatggctttgctagtctggtctaaaaaaaaaaagactaaaacttaaaaatgggggctttgaggtggctcaaggatatggagtgctatttaggtaagaccggaaaaagactatctcttattgactttattatgtttgatgtagaccatccaagttatataacctcaagtggaatttaaagatgcatttttttaatccttatgatcattcaggaccttcacatcttcaaataattctgtaaatgagactcaaggaagagatagcttcattctctaattattaacgaggttagttatcactacggtgaggtgaggccagtgcttatcaatatttctggtgcatacaggtcacctggggatttgttaaaaggccaattctgatgaagaaggtttgatgtggggcctgagattctgcatttctaacaagcttacagatgatgctaacgctgctggtctgtggaccacactttgagtagcaagggttagcatatagccatggacttgaattactgtcaagaggtctgctttccccaaatgatgaatttgcatttgtttccttgattctagatggaatacaactttgaggggaaaggtcagaatatatttgctctttataaatgtaagtcttggtctgagcagtgttagaaggaaaaaccaaaagaaaaaagcacttactgggccaggcacagtggctcactttgggaggcccaggcaggtggatcacgaggtcaggagatcgagaccatcctggttaacatgatgaaaccctgtctctactaaaaatacaaaaaaattagctggtcgtggtggcacgcacctgtaatcccagctactcgggaggctgaggcaggagaattgcatgaacccaggaggcagagcttgcagtgagctgagatggcgccactgcactccagcctgggcgacagagtgagactccatctcaaaataataataataataattttaaaaaagaaaaaatcatttagtagcaaaaaaaagtgaagaaataaatcaattaccaccaatacattcatcagtcaattgtaaaattgaaaataagccaatttccattatccggtgagtaagtaacctgataaaaacaagtgccctggagttcagatggctttagtggagctcggcctaacatataactgaggagtaatacaggcactgagagaatttagctccataacaagaaaacttgtgtacaagttagggctcagctacacaaacagactgaaaacgggcatttagacatttctctttcaaacagcatgaatacctaatgtcagtgagccccatgacttatatacctttaagctcatataaattgaaatttgaaggattccagccttttcccaggagaaaacttgttgttttgcactatctgtaaatctatgtgaattttcagggcttgggaagggaagagacacataggctcagttaatctgccccgatgcaacctggtttgcacctgtacaatattgcaccaaagcaacaacagcaagtgagggtcccaggtgagaagaggctcactgattctagaaaatctttattctgtaaccgaacacatcctgttttcatctagaagtagtgccttagccatatgaaggagggaactgagaacttctacatgtatgtctcagctgctctgtagagaaagaggggtgtagattccatgagttgcttaattttgctataaaggacaatatctcaacgggaaccctttatttcctcccagctagaggaagctagcagaaaaggcagcccggctctttgctggctctggctgttcatgtcctgccggctcctcccatcactcccttaggagctgggctccatgtccttgataaacatgtgggaaccttgctccctcaagggtattgccaatttagaaaagcacatctgcacactggactcttgttgggccttgtgtagtttggaaagccgaccccggtttcacgtacatggagaaactcagaatgcctaggattttgagtattttaagttacaggaaaacaggactctttcttatgtccaattctgacattgtcaaaggaaaactggttggctaggtttgagacttatataatttatgtaatgaggcctttgaatttatatagaaagagcctgaacttttattaaactggctttgcagagctactaaaggagtgatggcttttaaaatctcttctgaaatggcttgatagaatttagggtagaattattcctctactcttggaataatgttcttttgtctctaatacccaggccttggagaattagaatatggcagttcagtaggctgtggtaggaggaccctttttctgggtgcccggcaatcactaacagtgatgtgtactcagaaacagtcattgggagagcaggctgacagtggacctgctaaacactagtttgatacaaaatgttaattgaaagttacaatatattttataatatatcaatatatttcatatttaaaataaactgttatgctttctcctatcattaaaaaatagcaagcagtacagaggcaagatgcaaattcatattaaagctcatctgattctgaatataaacacttcagtttctgagcttgccatgaaaatgtttcctccattaacatcctgtcattctcttgttgttctcgtggccagtgcagaatggagagtctgggaccaaaattgagttgttgcgccattaaaaaacgtatctgatgaaggtggatcagtcctggttgagattcaaaaactgagacaacatgacacagctagagaatgttgtttattccttgtccttcttgagtgaagctggacgttggctgcttcgatctgattcagatatatatatatatatatatatatatatatatatatatatatatatatgtactttttctttttggctataaatgtcaacatctctttgggatcctaactgcaggttggagttgaattttgtgcttttcctccaccagcttggttggtcacgatgtgtctcttttgcttgtttcaacacatagcccaggcccaagattacagcttccaggatacatttttcaggtgtgtaaacaactgtcacagggcacttggcacctagatttggaggtcatatgttgaagatttgacaatggttttgttcagagggaactccagttcacgtttgggtgtttccagtaatggcgtaagacaaaaagatcacagttatatttttttctatctgtatatatgtatataccattgcactgagtactttttaataagctgtggtctgtttcaataaaaatctacatattactcgtctaacaggagtttaacattaatttctattcatgcagcctggcacaagctttctactaccacaagcagacagttactattgcgatccctgtaaactcctttctcagtggtgttaatgatcccatttccctaatgtttattttggcggcagtagagaaggaaaggatactgtctggggcgtcatcaagcccaccgactgcaaggggagagaaggggttgttcgtgcctactgggaagtcaccagatagctgtctaaggtactgaaatcaaaccctgcagagtcaatagggatccttcatctgcttctagcaactcttaggggaagaagaatgaatgtagaaaactggggacatattttaggatttaaaaacagtaacttcaaaagagtagtaacctactggtagtgcaatgacttcacagtatctcagttgtggtactgtgatgggagcaacaccgtttgtcctgggatgaaacattgattcttaatttggagtgtactgtttgttgagttgcactctggaggaggaggaaggttctggaactacgtgctaatcccatatttctccctgctgattttaccactatttaatgtgcactaattactttttggtaactactgactgcattcaaacgtaacatcaaggtgtgatctagatacagtcagtctgggctgctgttgatgacaaaggtgatttcatttgttctctattgaaaacattgtacttaagaatattaattattctcttcattttaagtacagagaaattgatgtattaggtgcttatatgaattggccaaagatgtggatccagtcttaagatttttatttattctgattttgtatgactaggtttcttcttttccatgattgtttattcacaaggaaattataaaaatttaagggggaaatcccccactatattaaaatcattacttcttcaatgctcttccttcttggcttttaataataaaaatagcttgtacatgctcagcgcttggaatttacttttgcgtacattttctatgtctcctaattcacaagattgttgttctaccactggcccctgctgaggtcggtcagtggtgacttggggccttccccccttgttcttttggattgtattaagcacttctagagacatgatgtcatgaagttacgtattaggaagatggcaagagcagttcatagacactttatgacaatttattgatgatgatcatatatatgtggcctttgatccaaaggtgaagacttttatttggacttcaatctaaggaggagtgagcccctagtctggtgtaatttaccaactaatgctatgtcctgaaattccactgagattagtggtcttaaagtatcacagtacatccctgactttacagtacatgaagctttaatatggcttaagcaatggcaggggtgggggtggttctgtatttctaattcaagtgtctagatattttaggaatattagagtgattttacctgtcactgagttgtcagaaagattatagtaggggatctgccattgggtcagtcctctaggagtgggcagatcttgatcagtacagtattggagtgaggttacataattaatagtttttacatatagccgattttttttttttttttgagacggagtcttgctcggtcacccaagctggagtgcaatggcacgatcttggctcactgcaacctccacttccggggttcaagtgattctcctgccgcagcctcccaagtagctgggactacaggtgtccaccaccaaacccagctaatttttgtatttttagtagagatggggttttgccatgttggccaggctggtcttgaactcctgacctcaggtgatcctctcgccttgcccaaagtcctgggattacaggcatgagccaccgcacctggctatatataccagattcttgagcagataattaaacctcctccaccacaaaacttgaaaataaggtacaagaaggcatgacatgagaatccacctgccccttttcccatctgactgtgatgctgaggtgtggtggaattagccaaaagatgtaggaagaaaacttgggtgagctacacccagaataattaatacttaagtcatcaagggttgattgtacttgcaggagaacgggtaactttcccacataaagctgaaatgctagtacagagaaatagccttccatttgctattacaggatcaatgtgcaggtttgatcactttttttttgaagcattttcttttgccaagaataaaaatcatgtatagctattgcactaccaataggtcaattcatgctacaaatgtccatgtgtttctaggatgccagtggctactgctaccagaaataactccagtcactcccttgactagtgttgctagtttggtctttagggtttacctaagtgagagcatcaatgatgggttaaagtcacagaccacaatgaataaatcacagtctgtgcacacttttggccaggaagagtggcagtggaatcttgcatgtcatttggttgaaattaagactaaatctctatatgtgcacacacccacactcacacccacacgcacacatatcacagggttatagcagaatgaaaacggtgggtaggaatcaccagttgaaggctgtaggtttaaatgatcaggattggcacactcagatcagcccaccagtggtcttcactttgtgaaatggaactaatgccacaaggaaactgcatggttacttcatctgtttacacatctgcttatatgttcagctgaactgtcactgaaaacaggagcaccattcttgggacatgaaacaaggaggaggggaaacattcagataatcaacagttaatagaacaagtaaaaaaataagccaacagcaggtgcggcatctctggtatgcaaaacaactaatgaaagtgttcaaaggaattatcaaggcaggccattaagactataaaccatcaaaagagcagcagcaatagcaagagagaaagaagagggttagcaagagactagatcttcctgaaaaagtggccttggctctacaattgtctaccttgtgctgtccttagaagaacaggcccagtgctacagaataaaaatctccatgccaagccactgccttcagaatggtgatgatgtcttcttacaaaggtaaacccaagatgacaaccacaagcaaaaaaatcacccttttgttttaccatcaacagatgaaatagtccatacagtgccattcaatttcccacaggcagaaaccaaagacctcagaatgagaaagtcatggttttcacgtcacaaatgttacgtgtggtcagattatggagcaatgaaaacatttttctgcgccgctcattacactaaatcttgatgtttctgaagtctcttggagtttgagatgtattggaatagtttttcgcaccaagattaacatggcacagtaggaacaggctactgacaaatccatgtccacttaccttacccacaaggttccctaagggttcccttcattctcacaatatttcattttgagatgacttaaggtcaggtagaagggaccacataggccactcttcatcacttctcctcctagctcagaggctcacaattgaggcacttggcccttttgcactactaacatctggggctggaaacctgttgctggataaatacagctcagcaaatccccaaccatatttctattcactaaggtgttattggattgctcctgtttgtgcatgtctgcacacacatgcacaatttcttgtcctctccctccacacttacagacatacacctggtcatgtggaccatcgaaacacaacttgtttggatggaagaagaaaactctgcagatgctgttatttttagaagcctgcttatccctcctgaatgccaacaattttggcttggcatccatttcaaatcaagcaaggtgcatatccaggacaaagcaatgtgcattatgtctgaagggatccacatcttcagtgaaactcagaatgtggccagaactagctaactacctgaactgaaagcaccccatgttcagattcagaccaactcaaaacacatgtaaggggtgcctattgtatgcagggtaaggtgtcaagtccctttttatttggattaagctcaaataagaaaggacctgaagcgaacgtgggatgtgtatgtgtgtacatgtacacgtttgcaaacacacaggtttatgtgggtattaatatcgagtggaaaatctggctttttatttgtctgtgtctttttttttttttttcagtctgattcgagtatatctgttttggcaagttgtgggcagctctcttttacttttgtcacccagaggcttccgtagacaaaaggaaaggagagaggtgtgttcaaagacccccatggcgaagagcccatcccccaagcctgacacaaccctccctcccagcggacccctcttctggactggcttcgctgttggctacttcagtgcatctgacccccaccccccgcgtgaagacctgagattgagcgtggatttctgttctccaccaactctgcagcaagggccctgccagaggcgtcgcttcctgtcatctcctcttcccgctcccaagtagaggcacctaaacagagattagatttctggtttcaaggcatgtcggaccaagcacgctgaatgaacatgagttagttaattagctcggtctctcttctttccgttccctggtctgaatgtttcttgatggcaaagcgaccaggagagagttgatttgcatcttaagacctatgggtaatgcttctggagtggggagatttatttagcaactgcttgaacttgtgtacggggtcgggaaggaggtggagctgaccccaatggggctatcggagattggggtgtgggtggtgcccactgccacgctgacaccccgggcctcgatgatggcagacaggagctgctgctgctgctggcgcagggtgtcggcgatgagcagcggcagggagttgaagctggcggtgagatgctccagcttcgactccaggctgccaatctgcttctccaggtcttcgctccggtcattgagttctgtgattaagtcatacatgacattctgcatctgtgtggagagagagaggcgagagacagggagatgacaggtcatcacagaggaatctgcaatgggagaaatgaaacgccctccacagtatgacaggagccacttccacaccagctgatctggtcaaggaaggatacaggcttctttcctggggatggggatgctgaagtgtgcacatttttgttttcttattacaaaagtaatgagtattaatgacagcattttattagaaaatatgcaccaaggggaaaaaaatggcccttttttttttcttaaataaagtgagtctctaaactgtctcatgttctcacagggccacaacctctcagctcacatggctgctggcatctaatgattccagagaagacgctggtggggaatggacagtgcagtgggtgtataattagtaggccagggctcaagtacacatctgcagctcactaacagtgtgccctctgccaggcgcctggcctctctcaatctcggttgccttataaaattggagttaataataactgtacacagttaggagttattgcacatctcccaacctctattttaacccagcagacaggatgtaaagtgaattaactctcaggcacagtgcttagccaaaggaggctgccttgctgaggtgtggcccttcgcctgcctgatccacaatgcctcagggtgggacatccctgaagggccactctgaagggctgaggtctttgttgactgtatcacagttcaaaccctcccactgaccaatcctgcttccctcactccttggcaggggtcctgagggtgctcccctgagagctccccagtacccctcctgcactcagcactgactccccgtgttccaggggtgccggccgattaccagtgctccttccccaacatcctgtggcccccttgttggtctgcagagtcccagtctatgcaacagatatttttctcccagcaaattagcaaatgccatcttggctgtgtacatcagacttgggaacaagattcacaagcatcttcagcctcccacgtgtcagggagtgaggctcctggggcggcaatgcagagggccaggccggtggttgcttggtcatccctgaggtactgtggctctttgggtttctgatgatctgccagtgacaccccgatcctatttcacgtgaaatttcaggttactctaggaagatatggacatgatttatgccccagggaccaaagcagcagcaagtaaggtgagaggaaaaaagaagagtaaaagaagatgtgagaagccagagaagaatgaaggggagcaggggcacaaaatgcagtgaggcctccccagcagactacaggccccatgaggaaattcactggggcagcataaggaaaggtcacaaggtggcatggagatggccccgctcccatgagctctgctgttgccagagcaggacaccgtgtcgtggatgcccttggaggacagggtgactttagaagtgaaagtactccctttattaatcaacatgacagaacctcctcgaggcaaacattcttcccggaatgtgcaaaatcacccatttcatttgaccgcaggggcaccctgatgagctctggactcagagtccaggcccctgggttgtggcccccacgctggtgctcaccaactgcctgaccgtgggatggtcactttgttcccttggatcttggtttcctcatctatattgataatcagaactaccaattgcaaaacctttatagtttacaaagcattttcacagatatcatcttattcgatcacctgagcctccgatggtaggaattatttttatatttcaattgaagtaattgaagcaatcggggaaagactccaagccctcccagctctgccagcctataggacagcaattcaatacagacgtaatatgtggaggccacatgccatattcttaatttagagaggaccaaagggcaggagtgggaaggcgctgacttgggaggctacagcacaaagacagaaaagagagagaacacagcgttattgtctccccctgttccgttgcttggtgacaggatgccagggggaatatggaccagtgtgaagtgtgctaagctgctgccaggaccttgggtgagtctcctgggaggaaaagataaagactgggcgaatgtcagagttcatctcctccccagatctccccacgggggttctgcagatttttcccttaaccctttcctgcacactctttctttccaggtaacttgctcctgggttatttacggcttagttcccccacccaattcacaggagtgtctttccagttcactgaggggttcgcttcacccggtctgctccgtgggccccatctctccaagaggccgtgggtggcactgcagaaatgcaggcttgaaagtttggtttgcccaaaagtgggcgaaggatatgaacagacacttctcaaaagaagacatttatgcagccaaaaaacacatgaaaaaatgctcatgatcactggccatcagagaaatgcaaatcaaaaccacaatgagataccatctcataccagttagaatggcaatcattaaaaagtcaggaaacaacaggtgctggagaggatgtggagaaataggaacacttttacactgttggtgggactgtaaactagttcaaccattgtggaagtcagtgtggagattcctcagggatctagaactagaaacaccatttgacccagccatcccattactgggtatatacccagaggattataaatcatgctgctgtaaagacacatgcacacgtatgtttattgtggcactattcacaatagcaaagacttggaaccaacccaaatgtctgacaatgatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacaccgcatgttctcactcataggtgggaattgaacaatgagaacacatggacacaggaaggggaacatcacactccagggactgttgtggggtggggggaggggggagggatagcattaggagatatacctaatgttaaatgacgagttaatgggtgcagcacaccaacatggcacatgtatacatatgtaacaaacctgcacattgtgcacatgtaccctaaaacttaaagtgtaataataataaaactaaaaaaaaaaaaaagaaagtttggtttgcctcatgtccccagggaacatcagtcacagcatgtcctgcaaggtgagaggagaaacaggaaatactgctactcatggaagaaacatcctggggcagtttgttgggctattcctgaagctcacaggtgggcccctagccctgtttgctccatatgaccctcttcctggccaatgctgattggtcccagggtggatacgtggcccaaattggccaatcatttcttctattctgagaatttagaattaagactagtagggggccaattagtctttacctgtggctaaaactattatatgtactctctgaattggagcctgttacagtctgtcgcggggacaggaggcagagagggagagaaagagaggaagagagagggagaggaagagagagacagggaaagggagaggaagagagagacagggaaagggagaggaagagagagacagggagacggagaggaagagagacagggagacggagaggaagagagagacagggaaagggagaggaagagagagacagggagagggagagagaactgaagcagtcacttaaacagaaggacagagaagaaatggtgagagacctcctggttgtgggggcttcccaggtctagttcgagtcagttccttcctgcagtctggccacatgtctcctttgaggttttgcctggaatgagactcccttatatccttagaatagatttctccatttttaaacctagtcccagcgggtttctgatattaaaaccaacacacccaaaaacctgagggagttctctcctgcatgcccacgttccactcccaccccaggctcctaggaaccaccctgcactccacgtgaacgccctcctccaaaggcacgcgggcctggaggcttctccccaaatgtgccaagccacttactccccgattgaagtcctcacaggtttagaaggccctttctttggttcaatccctttattaaacaaggcacctgcacgtggcccgacaactagtgatttctctgattgcactcttttcaaagggtgcttaatgtgcctgagggagtttctcttgcttacccagggaatgtgttccattatgataattgacatctgctggaatgttctgccagcctggccctgggctgtacacttaatatacaattcctatcaagaggcaatgaggagagggggctgaggagggggaggccctttcttcagtggcaccgactctcagctctgccagcagtgtggccttcggctccctcacctgggtgatttgcaagaggagtttccttacagtatttatggcagctcagggccagaaacagagtggcagagtgatggcgagccttacaccctagggctctcaaaagagggctctctttttgggtatcttcatgttccttgtaggctatctgcctcttgagaagtaaagaaatgcacccccccacacacaccactgccgccaatttgaggccagcaaaactagttggttaaggactggaggatgtacaaaaatgaacttccaagtattacagcaaaccggtgtgacctgggcagttaccatggccatcgttaccgtctggtccttgctagcatgcttcacagccgtgcaaactcaagcccaacctcaggagtccctcaatgtgcagctcataaaatgacacggaaaaggtttagtcagctcattaatttcacgcagagacacacctgagcgatttcacttaagaaacaaacaccaagtttcaaaagcccacaagacataccggtagattgcaaatgaaacaaacttgagcctaggtatttttgaaccaagcagaaatttttctttgcttgcctggtcccgcgctgtccagtgcgaacccagccaggactcacaggtgagcctgagaagactcagtgtctgcgtgttctaggggatgtctccagacactgccactcaccttggaaaggtccaccagagtgttggcttggtcactcagcttcctctgttccatcttgacgctcctcaacctgtggggaagaatggtaacaggcaagcccttcaagtccatgcaaaggtttagccccaccagcagatcctccagccctaccactgcctctgattttggaacccagcatggggaccgtgaacctggggaacaactgaggcttttactttccaggggcttgtcacatccccccagaaagcaaactcttgtctccacgcatgctcaccttcagtcactggtttcttgctattcccagatcatttccctgcctctatgcctgggctgcaccttccatgttgagtgccttattctcaacttttcagggattccccaaacctctccatcagaatgaatgttttcatcctttgcttttccactatacttttaaaaactcctccatcacagaaagcatcagccacggtttgttttgatttgagttgcaatgcatggtgtgtgtgatgtgtggtgtgtgcggggtgtgtgtgtgtgtggtgtttgtgtgtggtgtgtatggtgtgtgtgatgtgtggtgtgtgcggggtgtgtgtgtgtgtggtgtttgtgtgtggtgtttgtgtgtggtgtgtatggtgtgtgtgatgtggtgtgtgtgggttgtgtgtgtggtgtttgtgtgtggtatgtatggtgtgtgtgatgtgtggtgtgtggtgtgtgtgtggtgtgtgtgtcgtatgtggtgtgcatggtgtgtgtggggtgtgtgcggtgtgtatggtgtgtgtgatgtgtggtatgtggtgtgtgtggtgtgtggtgtgtatggtgtgtgtgtggtttgtgtgaggtgtgtgtgtgtggtgtttgtgtgtggtgtgtatggtgtgtgtatggtttgtgtgaggtgtgtgtggggtgtgtgtgtgtggtgtttgtgtgtggtgtgtgggatgtgtggtgtgtggggggtgtgtgtgtggtgtttgtgtgtggtgtgtatggtgtgtgtgtggtttgtgtgaggtgtgtgtggggtgtgtgtgtgtggtgtttgtgtgtggtgtgtgtggggtgtgtgtgtgtggtgtgtgtgtggtgtgtgtgtgtggtgtgtatggtgtgtgtgatgtgtggtgtgtggtgtgtgtgtgtgtgtgtgtgtgtgtgtgtgtgtgtagaatgtgaaagctcttagaggttcttactctagtttttaccttccatagcagcctgcccaattcctggcatgtggctggtgcagtcagtgagtgatcagacccagttcaccactccacttgttgagtggaacagaatggatttcttctgtgctactgacagagttgtaggagtcccgccactcccagtctggtcatctgatggctgaaccgctctggcatactcactggtggatagcttggaggaacttcctctggtgtttcctcactttggcatggtcaatcttctttagcagctttgtgtgtttatagattaaccatgtttcccgaaggacattggctgcagcattcttgatctaaggaagaataaataaagtaggctgctatcaggttcattttcttaggttcatttttgtggttgctactgtagtctacctcataaggaaacgattttgcaatgatctattttcttaaccaaaatcacggaactcctagaaaagatgattaaggccgggcacggtggctcccgcctgtaatctcagaactttgggaggccgaggcgggtggatcacctgaggtcaggagttcgagaccagcctggacaacatggtgaaacccgtctctacaaaaaatacaaacttagccaggtatggtggcacatgcctgtagtaccagctactttggagactgaggcaagagaatcgcttgaacctgggaggcagaggttgctgtgagctgagatcacgccatactccagccttggcaacaagagtgaaactccatctcaaaaaaaaaaaaaaaaaggaaaaaaaaaggtgattaaaattcatctgttcttaatcttgtgttggacactgcagaccagagcttgaagttggagggtctttctttctttctttctctttctttcttcctttctttctttctttttctttctttctctctttctttctccttccttccttccttctttctttcttccttcttgattatttcaatactatctcttgactgctgttgctgatgctatatttagacaggctgcatgagcgagaccttgagtcccggggtccccttggaaaatagctagcgatataccattgctgcccttacatgcagacttccgagctttgcctgagattgccacttcgtgtatacggtacattgcttgggttcagagagtaaacagatttcctatcagctggagattttaaaagacttctttgagaaaatgtctttcccactgattggaactataggtaccaacgagcccattgtctcctttcccaaatggccaaaaacatttgcactgcaattgtacatgtaaatgtaattggcacaaaaaagaaataatttcagagcaatgtctgaaaatcagtgaagatatttaggtgtgaaaccagagcttcctcttccccagggctggctccttcactgtgcactgcaatcacacgtttcaacatatgacgctgtcatccattgacatggaaaccactgatatcaccaggctcatgactgagctgagacatatcaatggcatccagatggcaggggacaaagttttaatccaaacacagacatcttcagcaattagtaacaagagcaacagaaaacattccttattaagcacatgctaagcagatttttgattaaccatccccatttctgtcagccatgcagactggcatgtgtccacaggcctggggcctggaaataagtaggccagcctaatagaaatcaggttactagccagaaaggattttaataaaattagagaatatagacctgcttcttcagactgacatcaacagatgggatgttgttaaaatactgagatgtgtgggaagcctaggaaacattgttttgcaggctgataacttttgtgtgtgtatgttttaaaaatttattactaaggctggattatatttttcattggcgctgaagtgatgtttttaaaagaacagctaagtcttctcagaaatgtctaagggacataaatattgctttttaaaaattcagtaaagatctgctgtgaaaatagttttaaatgacttaactgcccacctctagtactttcttgcctgaaaggaagcaggttgtggtggaaagttggaaacggtggatgtccaggagaggacactgtggtctctgggcttctgctcagggaactagagtgaacagcagcctcctggcaaaaaaggcggcacggaagggaagccttgctctctgcagagcacacatttaatactactgccctcctcttgcagggagaggaggcaattggatgtgtcatttcttcagtttccctacgcacttagcctcttaggaaagcctcaaggaaactggaaagtctgcaggtgaatccctgctctgtcaattattaagcagtttaggagcaaatgcttcattatctgtaagatgggaaaaataaagagggctgctatgaggcagtgatgatggtgctgggggcaacacttaacatctaccaggtgcagccacaggtctgagtacttcatatgtctaagctcctttaatcctcaccacaaccccatcagggaggtgctaacattatccacattttacagatgaagaaaccaagacacagaccaagactagacaattattaatggcaaactgagtcagtgtgggtgtgaatgctacataaaatgtaaagtaccatacagatattagttaatattatctagctcaaacccctcattgaacatacgaggaaaccacttcagagatgggatgtgagagccagaatcacacagctagctaatggcaaagtcaaaacaagagccacgtccaggaagagcagaaggttttcatgtggactgaaggaaagacaaacaaaatcatttcctgttttccaggatcaaggaactggaaagagcactggattttttttttttttaaatcatcatggccctcacttagcaatgtgacagaacacggagtccaggtcctgcacttaacgtcagcccaaatgtaagatactgaagtcacagcacggcccgggtagctgagagaggcagtcacatcatctttatgagtttggagggaggcctccgtgcattcgggaaagtgatgttaactgccagcccttgcactgactctgaaattaattaccagcaaacagcctggcacaaagctaagtagatcaatatctgcgagagaaaaagaaataggcttttaactgcactgtgctttcccaggtggacagtaaatgctattgtggccagggtctccctccagttcacctggctgattgatctaagcattgttggggtcgggagcacatgaggtcatgtgcccttcctcagatttgccgagcctccaaagggctccatgcacccttccttgagggaggcttgggtaccacctgacctctcctggtgggcagaggcaccagggccaaaagatgctctcagggtgcagcagtgcgagagggcagggcttaagatgaaagcagcaagccagaaagagtggctcaaggttggccacaatcggatgggtttggggatggttaggagaggaccctttgtgaatggaagtccagctgtcctgcctccaaaacccataaacaaattggctgattgttttctgcaagcccaaaaactctctaccaaaaaattgctttcactctgattggggccagacaatgggctctatgatctactttaggaaaggctctaagattaatgggcctgggcaagaaagtggtccaatgaagaccttgcaaattatggtgacagctaacatatactgagtgcttactacgtgccaggctttgtgctaagcacatatgtctgcactggttcattaaccctcagaaaaacttgataaatagacgtgatcatcagctccaccttggacccactgctgaactctctgagactctctttgttcatacatttgaggaacaattaatgagcacctatgatgggccagacattgttgtagcaagtgacggtaccacagtgaacaaatcaataacattgctgcgcttacggaacttacaatcctgcggagaagacggtatgcagtttgtatgatagcatcaggtaacaagcgcttaaaaaaccacaacaacaaagcagggtccagggctagagagtgatgcaagtactacctgcatctgtgaaatgggattactgtgttgattaaatgagaatatacttaaaacattagcacagatcctggccatatgcctcaatacatggtacctttgttaatattctctccttccaataaatgtcagcttccttccctctaacttccccagccagcaagaaaacatacaacagaacacacacctcttccttgagctcttggccgcagcatcccatgtcaatgacttgctctggccacctctctgcccaggtaacctgctacttgctattacagaggggctgtcggttgcggcaagaatgcttggggcaggagtacaagggggatgaaaggagcacctttcttgggcaccctaagcctccagcagccccaggagccctgggaaattccaggggtcccattagcagagccccccagagaagaaatcactagcatgcccattatgctgccaggaacccttgccagggaagtattctacttggaggttggagacggggaaagggaggcctggccggtgggtgtgatttaaatacacacatcttggacaatttcttcagtgtgtgaacatcacagagtgtacttaaacaaacctagatgggacagcctactacacacctaggctgtatggtatagcctatcgctcctaggctacaagcctgtatggcacattcctgtactgtaggccactgtaacacaaatcactaggggagaggaatttttcagctctgttatagccttctgagaccaccttggtatatgtgcaccatcattgactgaaacttgttatgcagtgcatgactgtaacttcaaggagttacacaggttgaaattaggctgagtgatgatcagatcactatcggagaacctgcaagccagcccttgactgaaggtgtccattacacacaggactagagaagggggctggttcctctttcccatttgccaagcccactctcccctcatcaccaccctgcagacttgctctggcttccccggctgccctctctttcatcaccctgcttgcacctcctctttttcctccccctgttctattccacactccctttacaggcttctctgcctgcctcacccagaggccctcactgaccacttagaactgggagctccacctctctggctggcaggaaattgggtagagagagaggaggtgtatttccgttgttcagagttggagcttgaggttctccctgtagcaatatggtaatgggtggtggataattctataatgctatttatgtgatactcagttagggtggagttaagctggcttttcttttcagcaggtctgggaccctaaccccatgctgagttccaaggaactgaccgccctaaagctgcctgcctgatggtctgagagcaaagtggatcttgcataggccgggggcccaccctcgcccctttctgggccttcgtcttctcatgtgggttggagtggctcttccctaagggtccttccagcttaaacgcacattgtttctgtgactattgctaaagaaaacctgcacccaatctgtctgggacagaaccttgtgcgtgatgtaatttataatcctcttctggggagaattagcattcctgataactgccctattgattatctgatccattgtaaagacttgaagacttgttctggaaatccactgttgagcccaaccagctgtccattagcagtctttagctaaaccttctataatctggcataacaatgactaccattgtttttcctacgaaataccactactaagagtaatctttgaattagcctgctgaagaaaattttcttctagcaagattatgatcaaactttggcatatgcttgtaattaaagaaaagttttcttcagtgtcattcaggagatagtaggtggggaaactacttaaaggtttttgagcaggaagtaatttgttcagagctaagcctgagagtctaaggagatccatggggaagcagagtgcaggatgactggggtaagggacgccgaagtgaggagagcaggtagcaggctgctgtgatagtgcgagacagaagatggcggcttcaagagtggcggggccgaggccctggagaggcgggcatgcgtgaacagccacggcaaggtgaaatcagacacagaaagtgctcagaccctcgtggggtccagggtccagaggagtcagaaatggggctaagtctttaggcctggcgtctggaagaacacgatgtcaggagcacaccagggaagttaggagaaggaaatagtttagggaagttgtgggtttaattttggtcttattcattgaattcatggggaagtgtacttgggtgagctacttggggcaagaaacccctgcagcaagaaggagataggatccttagcacactgtgctgtctgaaggttctgctcactgtggcttgatgtggagagtaggtaccgcaaagaaaatatctccggtccatggtgcctcccaagccaagtgtgtccatagcagcccactctgccttttttttctttttctttccttttttttttttttttgagatggagtctcactctgtcacccaggctggagtgcagtggcacgatctcagctcactgtaacctccgcctcctgggttcaagcaattctcctgcctcagcctcccgagaagctgggattacaggcacccaccaccatgcccggctaattttttgtatttttagtagagacggggtttcaccatgttcgccaggctagtcttgaactcctgacctcaagtgatccgcccacgtcggcctcgcaaagtgctgggattacaggcgtgagccaccgcacccggcccactctacctcttataagaagaagtgctctctgagggcagtcagccaccagaggttagggatggaggtgaggaccacctcttacccatcttggtgcccccagagtacagagtgtggcacccagggagtggcctctgtgatggatctgtttagctacataaaacagaaagatggggacatgaaaacactaagtggcagaaaagatggggctctagtatctttcttccagtccctctgtgaatcatgtacttaaatattatctagtagcccagagattagcaataagttataattacagaataacaatggcagtgacactgcgaagtcagtgtgggaagatctgattgaattaaatacagaaatgacgttgccaccagagttgataagtcatacgaggaaagaagataagcatgggactcaagaaaagcagaaattgagttcttacccagtgctatcagaccctcttccctccctacaaacaaataaataaaaatagtgctggctctcatggcaaaggctaggctgcagtctttagagcaagacaggatgaataaatactagaacaatttgagtattttctatgattaatagctacaattccttttttcgttttgcgtaggtctttgaagcatcaaggttgcatataccggtaagagactgcttttatctgtcaaatctactaattgcccactccgaagaggttgcaattatgccacagtcaactccttcatgttggatctttctctgagaattcactgagatgttatgaatagactgagcttagcattttttttttttttttttttgagatggagtctcgctcagttgcccaggctggagtgcagtggcacgatctcggctcactgcaactttcgcctcccaggttgaagcgattctcctgcctcagtctcccgagtacctggggctacaggcacgtgccactacgcccggctaatttttttggatttttttttagtagagacagcgtttcactgtgttagccaggaaggtctcaatctcctgacctcctgagccatctgcctcggcctcccagagtgctggcattacaggcatgagccaccgcgcccggccaagagcttctaaggatcatgtctgagagtgagtatttctttttttttttttcttttttttgacagagtcttgctctgttgcccaggctggagtgcagtggtgggatctcggctcactgtaaactctgcctcccagattcaagcgattctcctgcctcagcctcctgagtagctgggattacaggtgtgtgccaccacgccccactaatttttgtatttttagtagagtcagggtttcaccatgttggtcaggctagtctcgaactcctgacctcatgatccacccacctcggcctcccaaagtgatgggattacaggcgtgagccaccgcacccggctgcttagcatcttcttgaccaatgagccactccagcttgatacaatggaccatttcaagaggacagaaggcaggccaggcatccccaggggaagagaggtggggttctcttgtgagcaggtcaaagtcagctcaaaccagagcaggccaaggatgcacacatccagtttcatttcaattaaggttatgtaaaagaaccttcagaagttctagtcctgccagctttgaaaaccttctctctgtaagaaccatcccttctgtgttgtttatttccttgagaaaagatattagatattaaagagacatttcaacagatttaagtgttctcagaaaagtgagatgttattcgattaaaaagctaccttagattcatgggtgagcaataaatatttgttgatttgattttcagtcctacttttcaagaagtggaattgaggaggatgttagggaatcatttttgaaagattaaaattagcaaccacagtctcatcttctacaattatattgcagaaaaattgtttattttcctggcatacaaaggagctggctttcctcagctttattttcctctagcgtctgatctacttggtgaaaaatggagaggacaaaggaataacaccaaatacaaagaatattcttggcttaaaaaagaaaaccagaataaacagagagactgctaatgtctctactcttggtaaacagcttatgagaaggctttggaggcaaaacatctccctgccctcactccggcacgtagtttcaatccagtgaaacctcagtaaattgcttcaggaaaatagatgcaagtggatttgcatttaggtgtttcaataacttgaataatttcctcaatactgagcatgacttttgcacccattattagagggggctgaaagagagtggccaagtggcagggttcccggcaggccttactgtgataacagccttcaatcactgccatcgtgatgtgacaaatcatggctttttttggtgcagctgatagctcagggccatgatgtatcaagtacaaacacttgaatgtcaacaacataagaatatttgcccgtaccagttccttttaatgtctgttaaggctctttacagaatccaataaatgtaatcaaagaccaaacaatcaaacaccataaataattctgctgagaaactggagaggccttggccgctgcacactctcccactgccttccccaagagctcgctcgcagctccctctgtcattctctctctctctctttttgttcttccttcctgccgttgtctctatttctaacacatttttgctgctgtgcaacattaatcactgaatattttctctagctttcaaaaacccaaatcaaaatttggttgctcatgggtcccttaacctacttcagtcctaaatgaaaaagactatggaggccgagacacgggcacagggttttaattctgtctcgtctcagaaagaggacagtcttgcaggaaatcatcttactgaccttccttcaggctgtagttctaaagaattttccataaaagctgtccttgaataaacagctcctgccttgcccatttggcctgctgttattctggaaggcttgtatctgtctattctaaatgggtcttttcatctcagacaattcagtggggtgtccaactttcagcagctaaatggtctacccattcctgcatattttcagattttcatcttccataaccacttccataatggttcaagtgagaaacattacccggaaaacccaaaagggaaaaattggatgatgatgttttgatgaacaattttatttagggatgtgggctctactagaatgattctttttttttttttttgagatggagtcttgctctgtcgcccaggctggagtgcagtggcgcgatctcggttcactgcaacctccgcttcctgggttcaagtgattctcctgcctcagcctcctgagtagctgggattacaggtgactgccaccacacccagctaatttttgtatttttagtagagacggggtttcacatgttggccaggatggtctcgatctcttgacctcatgctccgcccgcctcggcctcccaaagtgctgggattacaggcgtgagccgccgctcccagcatagaatgattctttaaatgattttttttaaaggattagacttaggtacattttcaatatacttttatagttttaggtatattttcaatatagttttgcccttcctaatgagaatcctgaaaatatttgagcataaacaaaaaacattgcctcataccgtgatttatttggtatcatcaggcaaaggggcaggttataccattgtaggctattaattaaattaccaggaaaattatttggctgcctgaaccatgcacagtgatcgaacagaagacaggaacccggcgtatgaaggtgctgtttccattttgtgtctggggttccctcaaacacaccctttaaaagcctggtgcaaacccatacgacatgaccatttgcttccttccttccttcttttttttttttttttgagatggaatctctctctgtcacccaggctggagtgcagtagtgcgatctcggctcactgcaacctccgcctcccaggttcaagcaattctcttgcctcagcctcctgagtagctgggactacaggtgtgtgccaccatgcccagctaattttctgtatttttagtagagatggggtttcaacgtattagccaggatggtcttgatctcctgaccttgtgatcgaccctcctcagcctcctaaagtgttgggattacaggcgtgagccactgcacccgttggaccatttgctttctgattggcttccactgtggccttaagtcccccataagacatggctgtgtggcatcttacccgcttggtgagctgagtgtccatcatgaagttatgaacgtgcttctccgctttggtgagttccagctttcgggccaccacggccaccacaagggcagtgcagcctgcaccctgcggggggacatcaagaggaccagaggggaaagaacatatcattaagaggcaagatgagagactcaacacgcctggcggccacgggggtaatttcctgggagtggagtgggaacttgagctctctggctggtcacgaccaagccacaaaaatctgttgaaatctgtcaggactctgatgtcctgacccacagaggggtctgcagtgcctcttgggttgtgctctgcagctgacctctgggaggctgagctagccagtttcaatggagaaggatgctgggtggcgccgaggctttggggggtttaaccaacaactaagcacctggtcagctgccaagctgtgcagcggaagacagaggggccagcacacacgggccctctctccctcaggcaggtctccatcccactgccagctctagaccagcaggcctgggaggaaagaaggtaggccatcagctggggtgcagatggaacacctgccagtggctgagagtgttcctgaaaataatcgaatgaagaggcaatacctttccccagggcttgtttcacagagggcacccaggttggcacgaacacgtgcactcagtgactgtgcctgctctacacttgggctttttcacctcaaggtttacgctatgactcagcacaaggaatcggttccttcctgccttcaccaggaggctcatgaattcaccgtcatgcagagattttaaagacaacaccacttctgctggatcaaaaccgggattttaagtgagcccgcagcagacccttgggattttctggaacagcgatcctagtctgctcggtaggtccgtgccaggggagcccgggggagggtgggcaaggaagcaggctctgctgagcccccagaatggtgggactcactttctctctcctaatcctctgggtgcatacttgactgtctgggaaataagcagggaattccctgcacattccaacattctcccaatgcattttaaaatcctcttcgctaggcttcttggttggcttgtgagcatagggggaattcagagactcactactcccctggctcttcggcaggcagcgggagtcagctccatccttctgcaagcggactcccgtcagagaccatcgccctctgcctgcatgctgtgccctgcgccgccctgaccaccactcatggaaagagatgatgaacttattaaagccaacaaccgaatcctgtatgtcaaacagtaattctagttgccacagaacccagtctagcagttgaggtcccagaatggaaggaatctgtcagtaacatttttggctcatcaggtcttacaaaatgtgtgagaagcagaaaagaatgtttttcaaaggtactataatctataaccgacttggaaggaatgcatatgggtggatccattccctactctctcttttagaagctatttctctctttatcccacaggctgacaaaggctagcctgtgtgaagtttcaatgtggttgaagttcacaatgctttctcctcgtttcccacaagggtccccattaaaacaatctagtgtttctcagtacatttgttggccttgtcacaaagtgaaaagaaccaagtctgtgtgaactttccttttctgacctcattttcctcttttgttcgaggacggctgtgttttttcagcttctgtgacttacaggagactctgtgcccaattttcaaaggatctgggcagttgcacagcctggtctgtagctgtaatcaatttagccatgcctccaaaagcaaaaaatagcttaaaagaagccatcctagagggaagatgtgtgctcccttcccctcgaccggacggagtatcatccctctcctttatatggagttccaaaagtactttgggctgaaagcccaaaaagagggctatatcatagcgttaaaaatggaacatcagatggagagggttctccccaggttccattctccctcctctcgctaggcccaggcaaaactctacttaaatcatccctgaaagctggggtccaataggcctgaagagggagcttccctgttccatgctattttgggaatgtaatcacaacaatcaatcatccaccattccaaatttccagggtctagatggggtgtttcacagcgcttgccatggcccacattttagctggctgattgcagggggggcttttaatgagaagctagagtgttttatctaatgaaccacctgtctcacatgatgaagataaatttctctctggaggcaggacagtggactagatgacacttcccagtttctttcaacatagagatgttatgactcccttgtgagtattcctctagaggatgctgcattcttaacccttaattccaacttaaatggatgctctcagcttcatttttccattgactggatgtaattagggcagtcaccagtaatgacacctaacctggtcttttccattaagaggcaacctaataaagatggggccagacatcagcagccttcataaagtggtggaggaatcctgaagcctagactgctgagcctctgcagactgtgcggggtgcggggcgggaaaatgaagaagggagagaagacaatagaacaggaggggaggggaggagagaggagaaaagagaagagaagaggagaaaagagaagagaagagaagagaaggtgggtgcagggagaggtaaagctgggcagaaaatgagatggggaacaagttgcgttgcatcctaaacagcaagggtcaaggggggaaagagagaaggaggaggctgaagaataagaaaaaatgatgggctgatgggattgagagaggaaggaagaacaaggagcctaaggcttgagccagaagtcaatggtccattttggccctttagaggacatgaaggaagtgccaagggatcccaccctgctgtgtccatcttcaagtggtataaggattgcctgtcccctgggtcccctttgggatgctgggccctttcacttaggtgagttaatagtctgacaggccacagtggcagcctggcagtgctgtgtcacatggcagtgatgcaggttagttttaagagacaaatcaccgagggcctggctaactgtggaatctttgaaatggctggtgggtagagggggtgtgtgaggagggaggaagcaggatgggaaagggtaaacagctgctgctatgacttccctggggtcagactggggggaagagccatgactcagccttttgctttcagatatgccaagtcctgaaccacaggggacatcaactggagtccctggatgtgctctgtccaacttccagttccatggggcgaggggagtggatggggtccacttctgatgagctggaacttcccaaggcacgtgggcgagagggagcaccgagtgcatggagagagggtggctgggacggggtgaacacgcctaactctagagattcggacccaaatctggaccgagactcctccacaccagtcctcccacctcttgttttcaagaaacattttccagctggaaaaccttagaagctggaaaaacaagtatcccaaggggaaaagtatgaggtgttcttaactaaagaagcataaaataaaataaaacacaaatgaaagtgacaaatggaggagggaagcctggaggatttacagttggattctgtttctgcaacagattccatgcaacaactaaaataacatcaattggtttgaaaccaaggtgtttcgggagaagctcatcttctaaaactgacattaagcagatgtcttgctgagccctctttttgcctcctcccgaaatgactcaatttgtgctaccttttacttcatcatcactttcccttggcagttcagaggcatctctcatgaggccattggggaaaagctcagcgtccctgcagatatccagaagcttttgcctgtttgtccataactgatgaagggtctacagagagagtccagctttagaaagaggctagattgaaacaaagttatgccaagcagccttgggggctttggggtcttccagatgcctacagaatcagaaggtcagcattgcacatcttttaggttgcactgtcatttccaattctggatactaaatattgacagctttctctctactgtgttgtcaccatgatcatgaaaaatccttatggaaagatgctggactttaatgtagctgcttttgtgggtgaaatctctcaaacacaccaggtctgtgccagccatggcaagttgttcagacaattatataccctgcttaatggttgataattacattgttactgggattgccaagagaaaacaatgattaagactatttacaggccacacacacacaaatccttcctttcccttcccaagcaggccttgccttggccttcctggtgtccatggtaaccaaacaggaagccctacctttagtaaaggcacttgcaataataattgggagctatacatagtgttgggaggttgggaggaggaggggaaaggatcctcagcaaagtgaaaccctggctaggagtgactcagctagaaaaatcacatttgttagaaaaatgccaccagggttcctcactgtggctgaccccagagtgaggcgactgactttaatttgggtgaaaaacactgacaataaatagaggaaacctccctgttcctgtatatagaaaggtgtatatttatgcacagggttttgtacaaaaagagatgaaaggcctgggctgtatttttcatatggaaggtgggaattggctcctcatcgtccgtttcttctttccactttgatcacacctcaatccacagggaacagaacgctctctctgggggagcactgcacacccagacagcaaaagggggtgctgaaagacaaacagcctccggaccccaaagagaggcaggggtggggccagggtctcgcctgttccgctcagctgtgccagagtagagccaggagatgcggagtccaggaaccaggaagccaggtctttggggtgctgcttcttggatggggacagctatgtgctgagaggggaaaaggtcggtattttaaaataacagaggctcccggcagggcccatccacctactggcaaccctgctctgtgccagccctggctgagagctggttctgaggcacaaagccccaggagtgactctaagaaggaaagatttggccttcagtggcatttcattcctttctggtaagaagcgtctttccccggtttcctcgtgacagttggtgctatgccaagacagactcctactaaccgatgggaggtatttgttctaaagccttgcacttacccgtgatttatcacaaccccagcgctaagctttttgtcattagctgctgtcgtaggacctgcctgctaatagggacctgccctggactggagtcagaaaggaggagagagcctggcccctcctgctcagcaggctgactgccccaagcctgggtctgaccgtctggtccaccaatatcagccccaggaagccaacaagacggagtggggtggggagtgggggcagcccccagccgctgtgaggcgttcactcagaccctgcaggaagacctgcggccctccctttgcactgcagaaaggggtcactgcccttccagaaagagggtcttcatctcttctggaggcaacgggggtgacaaatggaatctgagggatcactgcaaggaaggattttcacaaaggtgtgaggggggctgtggacggggggctgtccttgggagggttgcggtctccagccatggagacccagagccacaccacaagcagcctgaccacttctcaccccgccacctcccccaacactacccaggcttagatgtgctttcctctttcagcctcagtttcctcctctgaaaaaagtgtccaaccctggtctgacactgttctaggattccaggacgaaggccaaagagcagcagctgcctgtcctggacccaaagtgcaatgaggcccagggaacacttcaccaatttgcaactgaaggacactgaggacaccaccaacactgacctgtgtgtggccgcttctcgttttcaaagcactttaacataaatcattgcatttggtccttgcacaaaccaatggggagggcagggcaggccctccatctccactttcccctggaggatgctcaggtccaatatgcagagtgcctggcccagggtccacagtgagcagaaactcagaccccacatccctctcataagccacactgtgatggccatgtgacaggtgagagtgtgtgcctccgcgagagtgtcgagtgtgggtggtagggcactgggcaggagagatacaccttgaaagggcacggcacacctgctgggcacctggagatgggatcacagccttgccaaatgccagtgctgcaaagcacttggcactcagagcccagcccctccataggcagaggtggaagcagaagcctgggaaaggcaagagccagcccagggccatgtggacagccccgtccaggactcaggtcccaaaggccgactcagtgctctttccccagtccctgcttctgtgagttccagctaaacatgatcagaaatggtgccaaggtcagtgggaccaaggcaacaggaaggaggacaataaactgcaagctccagtgctcactggaggtgagcaaactgggtggctgcacagcagtggggtgggcatcagagcattgggccaggaccagcttcacccagcccattttgagggagctgtgaatagaccattaactgccaggagtccaggtctcattcttaccttagaaaagttaactgaaaagtgagaaaccattgcagatttcccacctgacattttatgtgtaggggacacacatgcaggtcggttaactaacagccaccccccgctctgcggctaggaaggcccctatgtgcttgcaagaaagagttcagctctttgccacattttaagggtagggaatggggagaggcgggtactcaccatgatgccagtgaggagacagacacctttcccacagtatgtgtggggcaccatgtccccataaccaatggaaaggaatgtgatggagatgagccacatggcacccagaaagttactagttacgtcctgctggtcatggtacctgccaatgggaagacaggagttagtcgatgaacagccattcctgggagtaagggctgtgggcaaacctagagcggggaaggaaatgagatattttgctgaggaagaggcagcagtgacggtggctcacacagatctctttaggctactgaaggggctgcaactgtgcccacccaggtcccacctgcagccccccgtcccgttggcctcccgccatgagcttggtcccagagataaaatgttttgtcatgatttgcacctcattgtagacatccttttagtgttggtaagatagctttggatgaaatcatgcagtaataaaattcaaattttcccttccaagccgacagtctaaatgtatgtggatgtgattaatctgaaatcacaagctcctgaacagggaaaatgtcaaaaaaaaattaccaaacatattcagcgatttcctctaagaaagttgaagcatctcaaagactggcatctcccgggggtctggagggaagctgtggtggttggggctctcgtggagctgtctctagagggggctctggggtgtccacagaggcctccctttctgagtcagacaggggcttgtagctgccccgccctgggaggaaccaactggaaacatcagcaccatttcctctgcccggatgcctattccaccccatccccttcctccctcccttcatccccaacaccaagacctgctgcatgccaggctctgtgccaagtactgaaatacagagatgaataccacacagcccctgccctcagggacccagcccaagagaggggtttgccaaggaggcagacatctgcagaggggtgcaatcagggggtggacaaggtgccctggggatggaggcagagggcaatgaccttgacccaaacacatgagggtccacagaggtgccacagaggagcaaggcttgcattttccaggcaggcccagaggaacgggtgctctgggcagagaaccctaatgaaagcccagggcttatacaaagtgcagcaagggagctggttgcaggctgggtggcagggctggtgaaggtgagtcctcttccaaaccgttctctaatgggatcagcctgaacaacacacaatagactctgtattttatactgtagggcttcacctcttgataaaatctcctcttaaccacttggaggccactggatggggaaagctaagaacaaagggccagggagaccaaacctactaggctggatagagcagaaaagccatttaggaaccttaatctatggaagtcagttaccattggggcttccgtgagttaatgcacacaacgtgccgggacaggcctagtacaaggaagccccctggaaggattcgctgccgtcatcaggaatctccatgcccccacagggtctgtgcccagcgagtgataggcaaatgctgcttttccttcccttggcgccttaagtgaggcgtgcagggcaggctgcatgtgtagatgcatctagagatgggcctggaaggagacaggagctcagccagtcagaaagggacagggccatcaagtcagggagcagcaagagcatggtatgacggatactgtgcatgtattgagcacctactgtgtggctggcactttgtacgcaaacattctcatctcacaacagtctttaaagtatttcccaggtaagcagcaggaggcacggagacactgggtgacttgcctaaggacacacaggaagcaaagcccatgctcctttcactgtttcactcaacatcagagaggcaaaagcgactggcgtgtgtcttgggaataatgaggaagcttcagtgagaggagagcacctgggctccagtagcaggtgaccagggggcttcagagaccaggggtcagatttaggaaggcctggaattctgggagaagaagcttggatcttgtcttagaggccttagaagagattctgggttcttgagcacaggaatgacaagataacacagcttgctgggaagaatggtcggcgggtggcgagcagggtatctgaagagacaggacacagaggtggggtgaccaggcaagaaacaggtgtgcaaagctgggacagagacgcaggccacagcctttctcacccaccggagcccggccctagcagattcccgcgagcacatcaatggtgggctctccagccccacttgagtccttggccagcaactggagacccagtgggtggcacagcattagcctttttgtggctgtctgcacaaggacatgggtgtctggtacttctggggacatctgaagaaaagataccccctccccaaagctctgctaatgagatggccttgcctgcccactccatctgctatacttgctccccagggatgctctgttaccaccctaggggcccctggctggctgcgtgggcctcatttccctgggctgggcctgcctttgctcccctggctatccttgagtagcacaggctggtggctcccaactctgattcccaggattgcgtctacccctgaccgtgacccagcgcatcagccccctcccagttctgctgtggccttggaaaggcagctgtctccctggcctgctcactctgccctgctaggccctcaggtcaatgcaacccctcccttcccagcaggttgctttctggctggagggatggtggcagaccctatcctcaggccctgtgctgaggcagtggtggaaaatcagactttagcttctctaaagcagcaagactcagtgactgtgggaggggacacagaagggagaagacgtaaaggcagctccacgccacaagcctgcaacacataaatgtaatacagtcacagccagggtcctcagttcttccgaaaaacatttcctggaagataagtcttgggtaaggtctgaagaaatgtggttgaggcagtttagcagtgaggagttgagctgagccagtgatcttgggctgggctgggcttgcctggcttggagctccagctccagagttaagtagctccatggctgtgggcaagtgacgtgccctctctgtcaatcaatttccttatccaatgatgggaggattaagtaaaataacccacaagcaataccagcacagtgacccaaattaagtgctcactaaatgtcagccattattgttgctgagagggcgcaggtgttatcagtctgagaaacaatagacagaaaaatacaggggcatggatttacacgtgcagtggagtggtgaggcattcatgaagatgtcttgaagtttaggctggagaactatttgatacagacacaaaagaaatcaactgtaagttcttggacaaagaaaagacatgagatacttagtatctgaaaatgattcttctacatgaaagactgactaaaggggtcaggccccagataagcagtgctgctagaagctttgcaggtgtccagggagaagcaatggagagccttgaataccgaaccatgaagttaggattaatttgtagcctgccctctgtgcacatcatggattttcttgtgcacgtgggtctccacagtcctcctttccctgcaaaccctgaggattaaactcgtgctccctggctgtttggctgcccttaggatcatggaccatcctattcatatgtgggaggatgccaaggtaaagagattagagatcaaagtggaattacatataaattatgttcttgtgggtttcttttttcattcaccataataaactcctgtgcgtgctaactgtgtgtgctgaggagaggagtgaagatcttgagagtgtccttcgttgtttgtcagccttcagtgatcgcttctctggtgggggctacggaagatgctgagatgaattggacatgcaccctgctctccagtggcttggagcttcgtcatggagataagacatacatgcaactcaccaagcaggaagtgatgagccagaaggctgggctggtgattcaggactgtgggagtagagaggagggagaaaaggtttctaaacctattcacaattttagagcggtttacacatgtcacaaactcacatactaatcttgtgctattttttgcaatagaaaatttgggggggggggatagctccatgtttttctttaaaggctgaggaggaaaagatgtaatttttctttgagctcaagggtagttattacagttactgatttatctttcagggtgtggactatggattttttttcacttcttaacatgaaataaatgagagatacaaaagactgtatgacttggcaaagatggtagagacatatgtctacttttgctcactcaaatcccttacagctcaaagttgttagtctcctacttttaaaaataagcaggcaaccaggaatccccagacagtcaggagtctctaacatgaaagacacagatcaaaccagtcaactaaacaaacaaaaagaaggaactctggatcaaatacagaccattcacagagagaactcttgaaggaaaaatcctataattaacgtaagagagagaaaataagatactggacccacgagacaagaatggaatgctgtatgaaaaaagtcttcctagaggggctggaagatgataaatcgaggaattctcccaaaaagcagaaaaagacaaagaatgaaaatgaaagaaaatatgaagttaggcattgtggtgtgtgcctgtatcccccagctgctcggaggctgaggcaggaggattgctcgtgcccaggaggttgaggctgcagtgagctatgattgtgcccctgcacttcagcctggggacagagcaagacccccatcatctcttaaaaggagagagagggaaagaaaatatgagaaaattagtgaatcagtctcccaattcaaacagtagaagttacagaaagaaacaactggggggaaaagaaggagaaagaaggagagaagtaattattttaaaaatcattcaaaaacaaaaatccccagaacttaagggcatgagtttctagatcaaaggctcactgtccccagcacagtggatgaaaatagatgcacaccaaggcacattattgtgaaatttcagaacaccaggggaaaggagacaatcctacagagctttaggggttttgggggagggtataaaagaggccaaatacaaagaaccagaaattacaacagcttcggactttttgacagcaacactggaagctagaaggccatggaataaagccttcaaaattctggaggaaaattatttccaaatcagaattccaaaccagagaccagaaatctgaattggccaaagtattagttcagtctgagggtggaacgaagacattttcagatacgtaaggttgtcacgggtttgcctcccatgcaccctctctcaggaagacacaggaggtatgcttcaccaaaacaaagaagtaaaccaaggaggaagacaaggaataaaggtaacgagctcagggtgatgctacagggaggccctcataggacaggtgctcaccaggtgcggaggacaacccgtccgggctggagcaggtcaagaggctctgggagacacttccaaggagatgaaattgataggaaacttaatgtgcctgaacatcctgaaaagaggtttagacaactgccagagtttgcacttgcattaatgacgaatacatagaaaactaagcaaacaaacaaacacgatcattaacaactccaggaaaaatgaaaagttctgcaggaagggaaaagttatcatattttttactacaaggctcaactatgaatagagtcaaattagtgttgactgagtaatgtaaacactgattactgctttaaccaaaattatgatgtaattataaaaggaagatgaagggagaggaagagttggaggagaggaaagggagctaaattttcatctcccagagtgggaagggaatagataatacctaaataaaccaaagcatcaaaaggtagcaatacacacatattacttacagacatggaggtaaatactaaaattaattagcaaaagaaggtaaaagtagctgcctctggagaacagtaaatgggaagagctggtggaagacagcaaataccacggaaggattgactctacagtgtatgcacatgtaactttgatcatatcaacagaacaccaaaccaaagagaaaaaacaaaactacatgcaacattaaatgacatcaagaaacacagaaagaaaataagcaccatgaactcaccatccagctccaacctgtgggatctacttgtatgttctctccattcttagtgccccccaccccaggatcatcattaccctgaatgtcatgtttatcatttcctcgtttttcttcatagtgcttccatgtaggcaggattacctaagcaatatgtaatttcatttttcctatttccgaccttcataaggatgaaatcataccacaagagtatggtaggaagcttctaaaatgacctcgatatcccccctcctcttgaggtcttcacacacttttgcaatcctttccttttgagtgtgggctggaccaagtaactggtttctaacacatagagtatggcagaagtgatagactttcatttctgaagttaggttatggtaagatcatggcttctgtcttgggtgatctctcactagttatcttttggatcactctccctgggagaatccacaggccatgtcgggaggcaagcccgtggagtgccacatggcaagggacacagcctgccaaccaccacatgagtagcttagaagcaggtgttctttaagtcaagccttgaggtgagaccacagccctggctgacagcctgacaatctcatgagagaacttgaggcagaggtacccatttaagctgcacctgaattcctgacccacagcaaccctgagatggtaaatgtctgctgtttttagctgctaaattttggagcaagttgttatgtagcaacagataactaatacagtgaactcttctatgaattgcttcttttctgttcaacatatatattatattgacatatgtagctatagtctatttttattcctgtattgtatttcatcatatgaatatggcatgatttatttattcattcacctgttgatggacagtgggatagcttacgggtttttcctctaatgagaaatactgctacaaacattattttttattgacttattgttattgtatttttagagacagggtcttactctgttgcccaggctggactgcagtggcacaatcatagcttactgtagcctcaaactcctgggctcaagagattctcctgccttgacctcctgaaatgttgggattacaggcatgagccacctcacccagcccaaacattcttaatcatagctcctggtacactgcataagagtttctctaggacacatacctaagactgggtttgctggtttgtaggatatgtacatatttcacttcattaggaaatgtcaagttgttttctaagatgccagtgccaattaggcttccaccagaggtggataagagttcctgtttctccatatcctcattaacacttgccattgtctgactttaatctctgccacactagtgggtgaattgggatctcatcaagacttgactttacgtttccatgataaaagcttaagtagcctttcatatgtttctttgtcattcatactttctcttctgtggcgtgtcattcatgacttttgtccacttttctattggcttgtttttgttttttctcattgattctaaaagttatttatatattctagataataagaattttgtcagtttgtgtgttgcaaatatcttcttccagtgtgtgccttgcctttttctctacagtatttttgatgaatagaagttttaaattttactgtaggtgactttatcatcctttaatttataattagcagttatttggtttttgcagaaatcattccctccctgagattgtaacatttttacatattttaaaatgttgcctttctaagtcttcaatttgcctggaattgattttgcatatggtgtgaggcagggatacaacttcatttttttcacatgggtaagcaattatctcagtttcacttaatgtgcagaccatcctttctcctactagctttcaatgctccctctgtctcataaattatatgtggaagtggtactatttcttggttctctattctgttccattggtctatttgtctaaccctgaagttatattacagtattctctgtagcctttccttggtaccttctgagggtctagcacataataggggctcactaaaatacttgtggactgactaaggcctgcatgctgcttttcctgtccctctacaaaagtgaggcttgcttcagtaattcagtgaatcatgttaaaatgatttcagctgttctcttcagcagattaaacctttgtcaaggtggctgccaaattccttgagcttggagtcagttctcactattaataagaactcagcttcatgacactagctgtgatctgttacagcactagggtgacagaaaataagccaaagtgaaatgactgcctcttcttccttattctccaaaagaatttgaatactttttaaaactagttttgtaaaaaaaaaaaaaaaaggattcttttcacatggatctacatgatatgacggctctagccatttgtcctgggtctgatttgtttgttggaaatttgcaggcattgagccagatcctctgcagaactccaaagcagccaaatggactgcttcgtccttgccttccggtcaatcttcagagtcacacagtcagacctgcccactgagctgtgaaccctgtgcttgcgaatttctccaatgaggaagccaacaacacgtacctggcttggccccctggcggcctctgaccccaccggtgcctctctcctcggaacactgccctcctctggcatctgcagcggctcactggcctgctttcctcccgccttcgactgtgcctccttggcttcatgctctgaccaccgcttcagggttgctgtgctccaagcttgccttgcacacatggctctcttgctcctgtcactcctgccctgtcctccctgatgccttctaactggcccttcaggacccacttcaaatcccatcctgacccacccagccaaccccagctctttgcctgtgtctcccacacgtggcatcagcaccatccacctactgcccacacactggcttgcagaaaggccgcaaagctggctggggtatagctgaacctacaggttccagggccagaacacctatgtttgaatccgggctttgcaccttaatgtctgcatgaacttatcctcagtcttcccacctgtaaaagaggataatacttgtaccacctcacagagagttactgtgagggttaaaggagctgatatgtctaaaatgattagagcagtgccgggcacataggtgcactaaaaaaaagtgctattttcatctcgtgtgtctatggttagccttggcatagcagaaagaacacaagatctggagcccagagactgcctttcatgccaaatggctctgtgaccttgagcagatcactccacggactcagggcctgctgcttcttcggggaagcagggtgtaatgatgccgtcctgcctgcctcgcgaggccgcggtgaggagtgaatgtgcacgggctccatcagccttcagcaagtgatacagatagaggtatgtcacagcctctgcaggagcctctcacctggggcttcgtcctagtgacaagggcagctgcacggatgtggagaaagaacaggcagcagatgctgctgtgtaggaaaacagaaactcctcccagcttctccttttaatcttcgctgttcttctgggtggctgcagccccttctcttcatttggtgacttgcagcttaaaccccttatctccatcaaattctgtcacctctgctttcaaaatatctccagaatcggagcgcctgtcatccctggtctgtggccaccctggaccagccccaccctctcaccttgtccagccccaccctctcacctggaccagccccatcctctcacctggaccagccccactctcttacctgctccagtcccatcctcttacctgctccagccccaccctctcacctggatcagcaccgccctctcacctggaccactgcagtagttgcctcactggcctccctgcttctgcctgggcgacgcttgcctcaggctagtcctgttacagtagtcagagaggccctctaaaaaaagtaagacaaaagttcctgtatccctcagaaaaaaagccgaagtcccctggggcccccaacctgggggcctctctgagcccatctcaccttcgcccattggccctgccacctggggtttctgcagctccttcacccagccagctttactcctgcctcagagcccctcacctgctgttcttttcagagatggccctgacttacaatggtgccactttacaatggtgcaaaagcaatacacagtcggtggaaagcgtacttcaaattctgaatgttgatcttttcctagggatctgtgatgcaattctctctcctgatgctgggcagctcgcagttaaccaggtgatcatgagtactctacaaggtcctctacagggcactgtgctgccgggtgattttgctcagcggcaggctgacataagtgttcccagcacgtttaaggtaggctgggctaagctatgatgctcagtaggttaggtacgttcagtgcattttcaacttatgatattttccacttactgtgggtttattgtgaagtaatcccatcataagtcacgggacatctctacttagaaggctcttatcccagataatttcaggcctttgcacaaatgtcagcttctcagtaaggtgttacccgcccaccctgtctccaagtgcactactgccccacacccagcaggccagcttctcccgagtcattcttctccacagcgcttatcaccacctgacataatagatatgtggcctatttttgtatttattgactgacaacccctattacaatataaggttcatggaggaaaggactttttctgttttctttactgctgtatccctagtactcaataaatacttgtccaatgaatgaatgaatgaatgaatggctccacttcgtctttctcacaagccagtgggacaagaccagcaggataagagctgttacctgattttacagtgaatcagtgcaaagctccagtgcgtaactgacctaactaacttctcacagcaactaagcgaaaagactgggactgaaacctgtattttttcggctgctaaagatggcaattgtagtgagctgggcacagggtggggcgtggaggcagcacccgtgtgcctgggcaggaaccattctagcttggcaaaatacccgctcagccactgccagtaggtgatggccgggaggctctgtatgtgactggcattcgaagctattagaagcctgaattagaagctattatgaaaggaaagagactttcatggagtcctgggttttattcccattcccagctctgcctttgtccaggtccccaatataatcaacttctaattatcaagtaccttcagcatgctagggcatgtgattccagctttatggagaaaatggggtgaaatcatcatttcttaagggtattatgagttcctttagtttaggagcatttcagaaatgcttgaggcgtgtgaaagaatcccattgaaattcaaaggcagctgaggaataaatggcctagggtgacttcagggctattactgcttgtgccagtgggtgaattcacattaaggcaaaaaaaaaaaaaaaatagttcgttcttttctcaaaaacaatttcccttataaacatcttaaaatgtaaaataaatggctttgaagactcagggctgatcacaagcctatcaaaccacgtgcccaggacaccacatgcatgtataaagccacccctccatccacttcacctctgtgtcctatttttcaagagttggctttgaatttaggaaaataacgacgttttcctctaccaggtaattcaaggtaacagccctggatctttccaaggcaactctaaatctagtcttttatttccagccctaagaactaacagcatggtgcaaggcctccagttatttttaaaaggagagaaaaccagcaccaccagagcacaatggctccaacaaacaaatgcgacttgccgccaaacaaccacagcttgttcttgctctgtgaaaacgagagtttggttggtgtggctttttctcaccgaggtggtggcatctctgtctccattagtggtttcctgtagaagcttctgagaaactctggaagaggtgggacagctggctggtgtcacacagctggatgcaacctctgcaggcctcagcggggaagcttcaacaccagcactggccaagcttttcttggagtgtgtttctcttctcttgggtctcttggtcttgctcaacttctccaccttgcaaatggatgcaccatttgagggaagccagctgccattccttccacagtccattttcttcttagagggaagcactgtcaacctctttgaaattaaaaaccagatggctcatctggcaaatccttctgagtcagtttctcaatttgcaatgttttctttcttcttattaaaaaaatatttccatgtttcctgatttggaaatgtttaataaaatgcatgaaaatggagaaaaataatatgcttggaagaagcactgttcccatgggaagcatgtcttccacggtatctggagatggcgtggcagagatggcatgggcagagagtccaacagacgggggtttggatcccagccctgccacctgttagctgtgtggcctagggaaggcgcttacctctctgtgtcttgggcttcacttctgtaaaatgaagcagtaaaaccttgcacgggactagtgaaaaatataaaactctgcatagtgcctgacacaaattttggaacttagtaaatgagttcatttggtcagcaataggaatgagccccctcctgtgtgcctggcttggtgcctacttgggaacttagagttctaggaagaaggcagacaccaagcaacaccaaggcaaaaaagggccgcgttacaatggagacaagtgatgccaagttggggcacggggccactgcgcaggggacacacggctatctcagaggagcaggtatgggttgggatgacagtgctgcgggtggagtggcaggctcaggagaaggctgaggtgagttggagggagaagcagggcggggaaagaactctgagcatcttctcaaagttgccagtgctggggtttaataagcagaaccccgtgaactcacaggcacagctggcctgcactgttactcttgccccaaacccctccatcttcttcctccttctcctctatttttcctgcctttgcccctctctgttctttcttcttctctttcatgcttctttttctttttttctcctttgaagcactgtctccacctccctctcatctctcctctcttgttttccctttcacttgttcagtctctctcccaccctcccctgtgaggacccacagaggaagctctgccctagagggaaagggtttctgcctccaaggagctggctatcccttggggacatcagtctttgtttgcttcaggttgattttgcttaatcagcaaacttgcattttgcacccactgggtggccagatacagatggcatcaaatgtcaccaggcagaatcctgtgctgtaaagtggggagggtaacatctggagtaggtgcatgggtccccccaacgtgggacatctctggaggggtggcaggtaaactaagctcaaccgatccccaactctgctcattacctgccctctccctgctgcccaggtcccctgcaaccccggccctcttcctcctgcacctcctattcgtgggcagtcccaccagctatccagccagccacactaggacaccagacactgttcctgagcttcctccccatcactccacatccagtgagtcagtccggtggaggttggctcctctagctctctcaaaactgcccttgctcttcatcccagccaccactgtacccaggggtggtgggggcagcattctgttactacagcagcctccccagctggtgtcccgtcttcccctcaaatcccccttccacactgcagccagggaaatctttctgaaactccagaccctcccctgctcccaatctaccagtggctccccctctcctaggtgtgggaagaggagaggggacgttctcagcctctgcacagcgacacactggggcagacaaacagtctctctggggctaatagtagttgaaggattgacatttgtgaacgatttattttttttgttatggcagtttcaaggctatcctgtgataatatcactctcgctatctggtactctgatttgctttcttcagtggaaaggaagggccgggactccagctagcctgatggaaatgatttataacctggggcacacccacagcagaagtcggctgtctgaatatcatctctcctgcatcgctggaatcaaagaaacaagtacataaataaggttggaaactgttggctgatagaagagtcattccaaaatccttaggctggtgaaaaaggcccgtgcctgctcctgtagcgttgagtgcactgccgcatcttatgacaccccagcaagcaactgcttattctctcctccaatccatgctcccccacctccgagcttccctcatgctggcccctctgcccggaggccccttaggcctaggaaatcacctcctccggaaagccgtcccggatcaagtgccctctgtggagccccttcttccccattctccctcacttctcaccaccggctcttggccatctccacccccagcaccagcctccattggttggttggtttgtcggtcggcaggtgctgagaaagctggtcagagctactgaaggaagctgtgaatgaacaaggacttaggggaaagtgacgtttaaacctggtctcatctcactccctgctgtgggcctctgctttctgtttaaagccattctgggtctctgcttgctctcacagctgctgtctgtctgtggttttcattgagctccacccgcccggggccctcagtctgccgcccgcgcctgcaagctttctctctcctggttgagcctttcccgacatctgccatcagtcacagagcgtgacttggaagcaaaggggcttcacagttcatcgttttttatatacagagagaagaacaacagtagttgggattcttgcaaaatacttcctcaaagatcttagagatgatctacttctcatttcattttatttctggggctatctctgtgtggtaggtaagactggatgctaatcttatttgaagagataacaataatcactatcatttctcaagtgccaatcacgtgccatgtgggccaaagctttatgcgcattactgaatttaatcctcaaaaaacaagactcataactgtcacttcctattttactgaattggaaaattagaccaggtgcagtggctcatgcctgtaatccaagcactttgggaggctgagacagaaggatcccttgagcccaggatttcaagaccagactgggcaacatagtgagatgctgtctctacaaaaaatgaataaaattagcagggcatggtggtacgtgtctatagtcccagctattctggaggctgaggtgggaggatcacttgattaattactagattaggaaacttgcacaaaataaaacatcaattgagtggcagggcccgagtgtgtgcttggacttgcctgcatccacagccctgtctttgaccatattgcaccttggaggagccctgtctttgaccatattacaccttggaggaggtggagacctaaaaagggaggtgagatgagtggagagactggtggggattctctctctctcaggtatctcatcctggatctgtgttataatgagccatgcttcccaggagagtaagacagagccagggctgccctgttcagcagcataggttgcgcactgtgcaactccaaggagtgccagtcacgaagacttcaatgtgaatggcaccccctggagggaagtgctgcataggcagtgctcctggcaagagccctaaagaaaagacgggtgtcttgctcttctcagttatgctttccaaagataattaaaggcaggcagctccccaggcaagcaaatgttgtggaaggcacacaaagctgcagcctcacctaggcagggttagtgtgggaaggacgtgggaatcaccctgtgaccaagaacaaagaggaacagcacagaacaagtaccctgggaaggaattttcttgtttttgtttcccagagcagtggggttcccagggcaggacgtgggagctctggttgggcgtctttccctgccacagagaagacagggtgccaaggaggagcctgggacgtcagggcgagtgggaagaattctgactcagcagaggttgcaaagtagcccccagggaatcagagagagaggaagatagagaaagagagggacagggatggagacagagacaatggctggaaggggaggagtctgagggcaagggcacctgggtgagggtctggcctgagcatgaggggcctgaggacagggatatgcacaataatgccctgacccggggtccccacggccgtggggcttggggagactacgggatgctcccggaccacaagcagcctgcccagggagtgcagctgtccctgacctctcgcctctttccataggcctgggctacgcagaaaggcacatttccctgctttctgggagtgggctctggccaagtgaagcgtcacgaagtctgggatgggagtagtttctcaggggctggtccggccccaactgcccacagccaagtcacctgagccttggtttacatgattaactgaaaattctggtacacgtcaggaataaagctaattccgaaggtcaacactatatggagaaaggaatggagacagccagtcgcacacacttttccctcagaagggcctttcttgctggagaagcttctaaagcctcgaagctggtgcaccccaagctctggagagcagcggctggaagggaaggctccaggcctggtgctcaggccaagggcctcctgcacccctcctcacccatttcctcggccccaggagcagaatgaaagagatatgaagagacagattgccttcagcaatccttttctctgcctcttgaactgagagattcttacttaaggaaaggaaggagcaggataaagagatgacccatctggagatgccttctcacctgtggggtctgaagggaatagagcaaaacccccttcgcatcaactctcacagctctgggcctccctctcttcatctgggaagggtggggggctgggtccatgtgcattagggccccttccagctctaaggagctgtaattctcagagaatgttttcttacccgtttcccacactagatggagagctggttaggtaggggagtgggcagctgcagccctgatccttgataagggtcttaagagaccatctttgaagacacagatgcccaggaggcttgccctaaatcagcctcatggtgacaagtgtcgtggctgtgctcggggtctctgcatacagtgggattctcctggggagcatcagctcagaggcccaggaccccctcagcttctgagctttcctggggcggtgagagcagccctggacacgtggctgaaggcctgggcagcaggggcctgcctgctgtgtcagctttaccatcagagtcactgagtcttggggctccctctagcccagttcacctcattctttttagataagcaaatggaggccagaaagcggagaactgggcatctggtgcacttctcaccacatgctgcctctttctagccacagggcatcagatgtgtgagctcggcagagtccagtcccaggagagagacccttggctgggagctcagacccgcccaactcgcggtgtgagtctggacaagttgcttcccttctttgggctttggtttcctcgtgtgtacaatatgaggatttggctaaagaagctctaaagccccctccagctctaagtcaggtgtttttttggatcacattctgtcccccttctctctcccactcccattctcgggacaactagcagctgggctgactgcagaggcaaaagccaggtgtctttccagacaggaggcctgtggcatcccgtgcagacaagatgaagcaagagtcagcaccagtggaaaccacctagcagccttcatccaggctggccatgcctcagggagctgcagcaggtgcctctcaagttacacagaacttctgatggctcctaacccaaggcttttcaccactggacacctggggtgcctgaaatggggcaggagagggcgtgccagtgccaaggctattataaaagagtaagaatggcaacactcagagtcaccatggaagccaacctgtctgtctgtccccctcccctgactcctccccatgaccccagagaagctcccagagactccttcgtccactgcatccccagcctggctctgttttaagggaagcagccaccacagaagatgcttgttacacgttgccaggcaacaaaaatgctgcctgaaaactaaaacccacctctgactcttcataggactggaaactggcagatgagaggagcctgccagggaacaaaggagaagcatcgagagggaaatgatggagttgagcaaccacagaaggcaaaatgaaagagcccagacagttgtgtaaagtgccagaaagcaaacagatggggaggaaaaactgactcactgaaattaggaagacagacagagagaggaggcatggaggaaagtcctccgggtgttaagtcctcgaaaggcctcctttattttttttctttttggccaaatctgtcatgagtagagatgaggctgttgataaggaagatgatgacaatgatgacgatgatgattccttaggtgaactctggtctgcttttatccagtgcgtgatttttattagatatccctcaagcaatggcacaattctccacagactttcagaaaacataattatcctctaaaacgaagatctacactgccattagcaccatcagctcacccaaatatagggacatcagcttgttagctgaagtgaccttgggctctgggatcttcaagcactgagcagatgaaggaaggaaggagtgatgttcagtctggacagccatgcccagctggcaagggaacctcggagaatgggagtgctccaggtggaggactctgcgggcagcagccccgggccagcagtgagaccctggctcgcttacctcccaaagcctccatttcctaatttctaaaatgggaaaattgctcctgccctgcttacttcacagagtgctgggccacagaggagaacctgtgtagaatgaatggccatgaacgaagatagtgctccttatttattaaaaaacaattcctagcctcctacagaggctgggcactgtagcagacattatcacacagacatgccccctgctgggggcgaggcaattaagcaactccacactatggtgggggagttaccccactgctcttggcctcagtttttccatcagggaaatggagataacaccacaaagcattcctatgaggacactgcatgtcagaagtttctcctccctcggcctgtggtcacccttgactaggctccgagcacccggctcagactcacctgcctccagttctgcatcacgtggcctcagggacaggccgggcacctcaggaatctatcctctaatttctgaaataatgaaaagcctccagacacatttactctctaaataaaatgcacagtttaaattataaacaagacaatttaagaatactggtaactaagtgggaacaatttcacatgttaaacttgacaaaataattctaaagctactactcagttaactatattcacatctacttaactcagtaagtttgacaacatagatgtttactttattaagtttgttatacattttctccaaaaaagtctagccagtcaccagaccccaccccacccctcgaaaacagacatcatggcattcaaggacaatgagccgcttctgcctgtacttactaataggcagtggcttccccctaaaaatcactgtttttctagaacaccaatcacaattcctttcctaggtaccaaacagcatgacctcaaagaaattagaaaatgactgcacagtccaagctgaaagaaaaactttgcgtcttatgttctttctccttttgtctcaacacagactcactctgtaacacacctccccagtggaacacataccccaaaagccctgccacaggcgatcggggtcccaagggcccaggcctcctccactgccctacaagtcagggccagggcagatcatgagcctccttgagccaccacatcctcatccacgaaatagggaccgtgggttccccgtcctgcctgctcacttcatagggtcgtggtgaaaaacagaagaggatgtccagtgttttatgtttcccccagctgttcaggtctcctcttgtttgaacttcctaatcccctgggaagcaggtagaccaggcttacttcctatctacagatcccaagaaagaggcccaggaaaggaaagggctcagggtttatcaggaaccagccagtcgcaggtgcttatttaatagagggcaggtgacttgcccaggatcgcacagctggtccgttgtcaagccaggctatgagcgcacgtttctgactccaggggccatgtgctgtcccttctgtgagcaataaaaccttccatgtaggaatgcaaagtatcattattaccattgttgctgatgttactaaaattgaaccaaaccggttttatcatgggttgactggaattgcatgatggagggccttggtcactaaatttaaaaatatggacttaatcttctagagggagcaattgaaggtttttgaggggtaatagtaggaacggtaactggaagccagaaaagctacttctgtaaactggtgtaagatgacagggatctgtgtcagggaggtagcaggaagagatgacttcaagcgacaccgcagaataagaaccatagagcttggtgcctaaatagagggctggaaatggggctgggagtggcataaggatggggaacgatttgagcctgagagatggttgcagcccaacagcacgtctcctcttcttcattagtaagagcgcccaggaaggagcaatgattaccaataataaagactacattttcccgccatgtgaatgaccaacggatgtaaatgaaagtgacatgtgttacttcgaggaaatgtccttaacaagaaagaaacaaccttattttgtccatttctctttcctgatggctaaaaggtaggtgggatggctggagctccagcagctttcttgaagtatgaggaagaagccacgtaccaacgatggcagggcaacaagggagaaggagcctgcgtccctgatgatgccatagagcagcatacctgctatagacacctttccggacttctttggcgtcagacagaacttctgttttgtttaagctattgttgttttgggtttcctatcacttgcagcctaaaacgaatactaacgggtaaagttcctgagaaaaagaagacacaaacagagaagcagagagagaatttaggggcaacatgatgagtttgatcacagatttgatgcgtgggacatcagtacaggagaagatgtatataaaacttggcatggtgcagggatgtattcaagaactctacaccgccaccaccgcccttctaagtcacttttgtctgttgcctggcctgctgcagtagcctttttagtcctcctagtagttttcttgccacctccaatttactcacaaagatgccaaagtaatatttttagaagcaaccatattgtattactctcctatttaaaacccttcaaaagcaccaggcatggtggctcacacctataatcctaatacttgggaacctgaagtgggagtattgcttgaggctgggagtttaagaccagcctgggcaacatagagagactctgtcgccaaaaaatttttgtatttagccaggcatggtggcttatgcctgtagtcccagctactcagagggctgaagtgggaagattgcttgagcccaggagttaaagcctgcagtgagctgtcatcatgctattgcattccagtctgggtgacaaagtgagacaagaaagaaaggaagaaaggaaggaagaaagggagaaagaaaggaagaaagaaagaaagaaagaaagaagaagaaaggaaaggaaggaaggaagaaagaaagaaagagagagagagaaagaaagaaagaagggagggagggagggggagggagggagggaaggaaggaaagaaagaaaagaaagaaagaagaaaggaaggaaggaagaaagagggagagagggagaaggagaagggagaagaagaagaggaagaggaagaaggaaaaggagaagaagaaggcaaagaagaagaaggaggaggagaggtggaggaggagagagagaggggaggaggaggaggaagaagaagaaggcaaagaagaagaaggaggaggagggggaaagaaggaagaaggaagaagaaggaagaggaagatgaggaggaagaggaggaagaagaaggaggagaagaagaagagaagaagaagaggtggaggatggggaggggaggaggaggaggggttggggaggtggaggaggaggaagagcaagaagaacaagaagccaaaggcaaagaagaagaagacgatgatgaaaaggaggaggaggaggaagaggaagaggaagaagaaggaggaggaggagggggaaagaaggaagaaggaagaagaaggaagaggaagatgaggaggaggaagaggaggaagaagaaggaggagaagaagaagagaagaagaggtggaggatggggaggggaggaggaggggttggggaggtagaggaggaggaagagcaagaagaacaagaaggcaaaggcaaagaagaagaagacgacgacgatgaaaaggaggaggaggaggaagaggaagaggaagaagaagaaaaagaagaagaggaggaggaagaagaagaaacaacaagtaaataaaaagataaaactctttaaaggctttccactgcacttaggttcaaccccacaacatggcactcagggcccttcactttcagcctcctgcccccttctgcggctcagtccctgccacaccccccttcatctgtttactctccttccagtgactccttccccccggctccttgccagctcagggccttggtgcagtcttctcattcttctcagaaggctcaccctcttggtctgtgaagggctcatttcctctcatccttcagacctcagctgaagcatcacctccccagagacacctccaagcaggccccagatgagtaggatcccaatccaatgccataaatttttttttaaaaaagaatcattgcaaacttcttttttccactttcacagtatatgtcatagatttgaaattatctactttttgtttccttacttgttacctgtcttccctggtagactgtaagcccatgagggaaaaaatcatgtgtgttttatgctttaagatatatttaattcctagcacagtgcctggtgaatagcagagctccacacctatacataacagtattattatttagcaagtctctcatgagagcactgcagctcagagagaggcgtggctcaatgctccacttgggatgcatggatgcattcctgtgagagtgcctgcattctccgggagcaagcatgatgaagggaaacggcagaggagggagaatgtccaggtaaaggacagacctgtgtaggaaatagggtatggggggaatcagtatgagatgtgtccagagagcaggagagatctcaacttcagtgctcaaacaatctgttgagaaatctgcgggagcctgagaaactaactattgcttttatcagcaggaaaactaaggcagagagaaatggacttcaggccagccctcaactcccttgctaaagctggaaacaggacaggagcctcttgtctctttgagtcctggctggttcccacgtggctgaaccactcctctggccttactgagctgtggctcttatctggtagtggccatgtggaacaagggtgcaagttgctccctgcaggattcaggctaaacaaggcccttacaattgtattgaagaaaagttaacaatagagcatggggctatagaatggaactgtcaagagtgcccaatctaaacagagatgggccctgggtctcgctccctaattcccaggccattatgcctgggagccctttgccctaagaatatgggccactctcaggctgcattaaaaggaaaataatgccgaggaaatgggaggatgcctaacacttggggcactatgttcgttctggggccttcgcttcatgaggacactgatgaccaggggaggagagtgagcgagagggtggagtctgaccagaagtcctgtgacaatggttgaggggactggagaccactgggttggagcagagaagattcaacctgactttggatactcaagggaccttcagtagaaaaagaaatacctggctgcttcactgggtactcaccgtgtgctaaatgttctacactgtgctaagggctttttgtgaattatcccctttcctggcccaacgtcacctgctagtaagagcataagcaaggctccacgctcacatcttcccagaggtcaatggcttaaccgccagcctatggtacttgaacttctttcgtgcggacccagagaactgagttaggacccaagacagaaactacacgttttaaccaatattaaccaataataggaagagatttctaagtcagagctgtctgcaaatggattggatagtcttttaaagtagtgtcccagagggtgttcaaaagaggctgcatgactctggtcaggttaagtacaagtgcaaggttaatggtagaaccaggggtcaaaccgagtttttccaccctgagttcaggcagtcctgatcacaggatggatcctgtgctggtgcgattgccactgtgtactaggtgttttccccttggctcagctgaaacatgtttaagatatttaaaaggagttttactaagttctgtgccccctctattgtgggagtgtcagagcccatctgggcccgttgcagcatgtctggccctgtctgagagggcccgcaggggctgtgttaccaggcggctcccaggcgccttttgggaaaacaaaatgaccaggtgtgttagggccagcaggcttccagggccactactcaaaggcagccaggggactttggctgcccttaaactctctgtgcagtggggggcaagcaggcatccagaccgaatggaacgaggtggggtactcaaggaatatggcatgtctcacccatattccctctcagctcagcctctgggggactggggccaagtctcagggaacagaggagtctgtattaaatggaaggagaacatcgttttgtttttgtttttgtttttgtttttgtttttgagatggagtcttgctctgttgcccaggctggagtgcaatggtgtgatctcggctcactgcatcctccacctcctgagttcaagcgattctcttgcctcggcctcgtgagtagctgggattacaggcgctcaccaccacactgggctaatttttgtatttttaatagagacagcgtttcgccatgttggccagggtggtatggaactcctgacctcaggtgatctgcccaccttggcctcccaaagtgctgggattacaggtgtgagccaccatgcccggccaaaaaaaatcacatttttaaaaacccttctagcagctgcgctatgtgagccaggaatgcagggctttaccccagcctggcgcgggggccccaagctggcagtggagggcaggggaaacacaggggggtgaagagctgcgctcctgagagccagcctaggacaccaaactcatggagaaggggccctgtggagctgaggtgcccgtcctttgagggaggggtctgcaccggaaatgtagggcacaatgggatcacgaggggcaaacaaaacaaccccaaagttgaaggatggaaaagctgacagaatatggatttcctgcttgactaatgtcagcccacaaatagatgtggctgacgtcacttacaggaaccccttccttttccttacctcagcccctccaaggaggtgggtgggggagcgggtgagaatgaagccccatgcccttaggcatccgctgtaggaaaggaagtcacttctctcctacacacccagcatggcactaactgtcactgtgtaccatctttggcagacttgggaaggaattcattccagtgacaaaggtcagatagtcctccccagttaaagaaggaaccctggcatttaactgggtctccctaaggcaaaaatcctggagacaaaagacactggtgacttcccagcagaagagagtgaagggaaacccaggtttggtgtaatgcagcaaataatttggaataatttggggattgacttgactgaaaaaatggaatggtttctcaatgcaatatggatttcactttgcacccacagtcccaaacttagtgcttcagaatgcaaattttatggaaattttccttgctttaccagtttcttttttattttattttctctctctctcccactttctttctcctctctttcttttccttctttctttctttttgagacggagtctcactcttgtctcccaagctggagtgcaatggtgcgatcttggctcactgcaacctccgcctctcaggttcaagcgattctcctgcctcagtctcccgagtagctgggattacaggtgcgcgccaccacgctggctaataatttccctatttcttgattctcctttctaagagatatcagccattacttataatagctaagtcatgtataattatttaatataaaagtacgaaaaaaactagccacgaatgagcagtttaagtgtcaaagggcacaaaaatactgccaatgaggaagaggaaagaacggctgaatacgagatcacagaacgagaaagcggccgcggagtgggactggagactgtgaatcacgcaggtgaaatcagaatgggatcccactcgagacaggagccaggagctagcagcagccctggagccgccggcccagccctgaagccgctccggctgtcgccacagcgagaggaaacctgaacgctctgctcctccacagcgagtccctgcaggtggggacaccgcccacctggccctccctgcgccccctggcggagcgagcctcggcctctcccgggccccggcctctccacgaccgcctggccgcgcgggaaccacccgcggactcgcggcctctccccaccggaccccgcaacaccgcggggacgcccgggaggctactgaagagccagtggcgcctgcctcgatcacacgtcccctgtggagctccacctgcccgcacgccggctcgggcgctcccataagcggccggccgcagaggggctccaagggaggcgcgcgcccgcgaagaagcactccggccccgcaaaggcgccccgcggccctgtccaccaaggccactggccgacgggtcggaagagagcccttcaagacggaacttgcattgcgcttgttagagaaaattatgtgtaaaaactgagccattcagctttactttccaccccgcgttgatgtaaaacatgagttcctatggaagatgaggggcttcgtcaagtgtgtaaaaacaaatgctacctctttccattaaaaatttatatatgtatattcattctcattgttgaaaatacaataaaaagtaataaaaaatcacatgtaacgtcataagaaatcaacttaatgtttacatgtatgaaaatcacatgtacaccttgggaagctgaggcgggcggatcacctgagaccaggagctgcagaccaccagccaggccaacatggcgaaaacccatctctactaaaaatacaaaaattagccgggcatggtggcgcacgcctgtaatcccagctactcaggagggtgaggcatgagaatagtttgaacccaggaggcagaggttgcagtgagccaagattgcgccactgcactacagcccggatgacagagcgagactctatctcataaataaataaatattacatgtaacacaaagaaatcaacttaatgtttctatgtattttccaggtatttctgcacctatctataaatcggtaatatcctacataatgctattttgtacgctcctttttcaaatattacatcatgaatattttcctaccttactgtaattttcaaaagattgatttttaggccgggcgcggtggctcacgcctgtaatcccagcactttgagaggccgaggcaggtggatcacttgaggccaggagttcaagaccagcctggccaatatggagaaactccgtctctactaaaaatacaaaaacttagccaggcgttgtggcaggtgcctgtaatttcagctactcgggaggctgaggcaagataattgcttgaacccgggaggtggtggctgcagtgagccgagatggcgccactgcactccagcccgggcgacagaatgagactccgcatcaaaaacaaacaacgaagtaacaaacaaacaaacaaacaaacaaaaacgaaaacaaacacgttgatttgattttttaaaattcttgctaactacccatcatatggatgtgccatacttgtttagccattgaaatcctagatgtttacttggtttctcattcttttctattataaactgcaccatgcagaagaggtttgatgtaaattgattattctattaaaatagcttcctagaaagagaattcctggatcaaagttacaaactcaaggctcctgtgacaaattgttaaattgttttccagaaagatggtctaatttccttcttgccctcagcgtaagacaaccccatgcccgcccaccgccaacaataagaagattctccagcactgagttatatttatttaaaattttgtcaactccagaggggaaaaagtaattctccttgtagttataatttgcagttctttgattagagggactgaatatgtgttgtgtgttttattttattggctttttgtatttcttcctttgtagttggccttatcttcagcctatttttttcactggggagataagttcttctgattagtttctaagactgctttgtataatagggatatttacctcttgtcatgtttgctgcaaatactttttctagcataacatttgctctttaaataagttcatattttttgagggactgaaatctaaaattgtgtgtatgatgtaatcaaacacaccagttttttccttcatgtttcttctgagattttatgcttaacagttctttctcctctcagggctgattaaatattcactttgttttctggagcttgctcatggtttcttcttttacatctgactttttaatccacctggaatttattttggtggctggtgagagctagggttccaatttgatttttcatccaagcttccaatttctccattaccatttattgaataatctatcgcttcccagttggttttctttctcgtatattgggttctaacatagtagggtttatttcagtgttttccattaggtttcattgatctgtcattattgatttttcagtaatgccagagggacttaattactttcagttttataatacattttaatatctagtagagaaagccccctcaatggtcttctctttcaaaaaaagttaagctattctcacttatttattaaaacatcctaagaatcagtagttattctccattaaaatttctaattttgtgttttcttttttctcaattaaatttatattttagaagttggtatcttttggatttataaattatgtttttctggtttttaaattcattaattcctatctttgcctttgttataaacttaatcttccctcctgaggtttgttttgttcttctaatggattcagttattttctctgttcatttttttctgtttttgttattaaaaatggggtctccctatgttgcccaggctgaggcagtggctatccacaggcacaatcatagtccactactggctcgaactcctaggctcaagtgatcctcccacctcagcctcccaagtagctggggctatcagtgcacaccattgtgcctgaaaaactttaaggatgtttttcatctgagtacacctttggtcacatcctgagtttttacgtacagggtcatcattgttgtaattttctaatagcctttaacggtagttttgaattctctgttgtaattgaggagattgctttaaaagtcccaccaaaaagttgtcctttaattggagttttataggcttgtggtcagagaatacagcccgagcaacttttctgatgttttgaaatgtgtgaccaagaagttgatcaattttttaaagtgttccctggatgcttaaaaagaagatgtttgtttataggctacaaagtgctcaattaatttaaacatttaaaaattcagattatcaatctcattttttgtataaaattcacagttttactgtatatagcacttttatccatattaaatggttcttttggacaatttaatgatttctgttttgaattcattttggtttaaaatgagaatttctattcgtttgccatctgatttgtacttacctaataaatctttgctcttcatttatttttgggtccttctgttctaggtacttcttttgtaaattgcatgcaattaaattttgcttttaaatctcatctaagagacatttacttttaacaaggaggtaaacacaattatgttgattgttataaattttaagtttgtttttctctgatcttctttcatactttgtattgaaattcttccttcctgcttcctttattttttctgtcttagctatgtgggctctgatgtggcatgggaggtatatgttttcagggtagggaaaaggctctcaggctggtgttggagtctcaagtctgctggctctgtggcctgaggcacatcgctcaacctctctgtgtctcaacatcctcatatacagaatgcagatacagtctcatagaactatggtatggattaagtgaaacaatatatggctgatgctactgttattcttgttatactcataaaattttgcctgtggttcctttaggttttaaaaaaaatatttctctgattgctaaaactgagtaatagggctttattttaaaattctcctctacataggacaacgcatctggcatgcttttactaatcccttctagccttctcctctcaaatttttaatctgaggatttgcaaccctctaattattattgaattattgctttaatttcatacatccactctttccagaatctactttttctttgacattagaatttggagttttgcaactacgcgtaagtttagtcttgatttcatgtttgcctgtgtgaaccaatgtctgcctttctttacaacatttcattattaagatcttaattgtgattcagtctttggtcaactggcaaacgagttccccccaaaagtaaactccaagaatgacttttgttgccctttggttgcctcattcaaatgacagggtggatccaaatttaaaatactgtggaactgttctaatgactctgaatttagggttcctgagggagagtcagctctgggatgcctgtgtgcctctaggattgtttcaccttatgattcaataaattttccagaaaaagaatgtattggggtatgtctaggggtggctcctcctgtcccccacattctaactggaaaagaggaatccgtttcgatctgcctactctgatctaccatccccacacacaacatccccttacctaggccaattctgaaaatgtttactgtgcgtatatttctgattatgcttttatccaaatttatcatttcttcctctgaaataactctaattcttagatttcacctggatcctatagcctccagttctgtcctattcatcctttctcttatctcttctgcattctgagagagctttaaattttttaagtttgtctccacattccacatttttaaaaatgtagtgccatcaatgtggattttcattttgctaaaacaattttagttttctggaactctgtgcttatgtgaaccagatacattttcatttcacatctgcccactcttctctatcataaggatcatatatattctggcaccctattagagatgcccaagactcttctttctttttccttttttttttttttttttgagacagggtctcactctgtcacccaggctggagtgcagtggcgcaatctctgctcgctgcactcttgacctcccaggttaggtgatccccccacctcagcctcctgagtctacagatgcaccaccactcccggctaatgttttttttggtttttttttgttttgttttgttttgtttttggcagagatgggtttttgctgtgttggtcaggctggtctccaactcctgacctcaagcgatccacctgctttgacctcccaaagtgttgggattacaggcgtgagccactgtgcctggccacccaagactcttctaatgttgctttttgtttttcataattaaacatttttcaggaatcttcaggattattttcctcttccttaatgctgcaggtttttctcaaaggcctccagcaggatccctgtcgcctccccaccttccccctccccagccatctatctctccgcctggcaccagaaggggatcgctacaggctgctccttccctacaggaggctaacttctcacttctccagctagagggcagggttcctgggtctagcaggcttcatcccatgtggtaggctactttcctatcctctctaactagtcctctgatatcataaaccagtggtttgcaaacttttaaaatcatgggctcctaccaattaaaaattttttgagcatgccctcctccattatacatatatttattataaattacagacatgtattgctctctatccatttattaaatactagccaggctttatatatatatatatatatatatatatgtagaagttctgatcatttctcccaatagtcccatggatcactgtgcgtgtgccccacattggaggttataactcaaaccaaagcagtccatgaggaaccacagtgcctggccccactgttcccaggctctgctcagttctgctcagcctacagggtttagcttgcaggcttccatcaaccccatgtagggtgcttcatccctgtaatgaccactttcctactgttttgttttggggtttgtttttttttttttgagatggagtctggctctgtcacccaggctggagtgcagtggcgtgatctcggctcactgcaagctccgcctcctgggttcacgccattctcctgtcccagcctcccgagtagctgggactacaggtgtgtgccaccatgcccggctaatttttttgtatttttagtagagacgggggtttcaccgtgttagccaggatggtctcgatctcctgacctcgtgatctgcccgcctcggcctcccaaagtgctgggattacaggcgtgagccaccgagcctggccattcctactgttttcttggagtggaagtaccccttcttggagggggtaggaggttgtgggaaggagatgggaggaggagggagctgtggtcttgcttcctgctgctggcaagtgcaggcctgggtgtctgaggcaggggcagaagagagtacagcaaggaagcctctttttatctccttacaatgggagtggtggctctcttaatgagagaaagaatgggccacaaattgtttttctcctgctttaggagccagatctccagaataaaatttctcattaaaatatcagtatgccaaaagttaaccagcaaaataaaaaacctgttgacagactggaaggcctgggacactgagacagcctgttgcagaatttggagcctcaggagggaccaaagtgaagggtccaaagggtccgaagggaatccactcaagaggacagtaaggtcatttataaagcatggctgtgacagcaaggctcaccccacttcatcaatgttatgggaggccttgttgctcctcccaaggagataaacatacaaaggtgagctggcaggccactgcactgctcaaggcacgctaggaaggctggctctccaacctgctgccgcagtgaggacccggggcctcagatggtctctccaccagtaaagctgcttggcacttgacagtgtaaaatcaggaggttcctccctgagggaggtgggcaggcagccaggagaatcccagagaatgcagagtgccacaactgtcaggcctcggaacccatgatgtaatgcctctctgggggccaaggaaaacaagcccactgttgtcactgccctcccagcaaccaggcgctgccctccccatggcacggctgttctgcgtaattatgatcccactttctctccttgggaggaggaaatatgaaaaacctttgttgtcacataaaaaccaacccaagatatgagaactgtcttttaaaatacatcttgctgtagagagatttccatagcaacttcagaagtgtgtgtatacaactagagataagtccaggctgatgaaagctacctggaatgtgaacaggctctgggcatcagcagctgtggatttttctagaacctgtcatgctgctgtgtgaccctgggcaagtcacttaccctctctgatgcctaaggtgatagaatcatcattagatcaggctgagagagatcaaggcatcctgtccacactaccctggtctgacgcttcagttccccaaagcttcccctgcttccagcttctgtccagtctctggctgaataagtcctggctgaaggcctctgccaatcttacttattatttgacattgggaaacagaatgatcatttaagcttgattctaaaaatagtgcttagtcttggtaagagaagtgctttgcctgtttaggaaacaatatattaacggggcagattcctgggaaacagtctgtgagatgctgagatttgggggtgggagttttactggggctgctctcaggatcaatacctctggggtatagaggaagttcccggatgcagtggtaacagaggccttaggcgatccctcagggaccctggagcctggctgagtgtcctactagaagcaaacggggttaggcctttgaactcccacactgacaaatcccctcgggagcttgctgcccccaggcaaggggtttgacctgaagagagggactcagtcacaaccccagctaagggaaggagagcccgggtcctggagggggcatctgtccccttcatgttgacatgaagcaacatgtcatccactacatggatgtgtttgaattggacatgaaggcagcccaggaggctagtatgataacatggtcaagaccataggcagcagaggcagagaaaacagcaagactgggattcacatgttagtctcagtggccttaagactctgagattgggaaagttgccagtagagtagaggccaagatttcctcgtatgtgcaggattcagcctgggttggtgacacacacatggaagttcagagtcagaaaccagttcagattttggctccacgcttattattaatagctctgtgacctcgggccagttactttctatcagtttcctcaactctcccatgagccttcatgtccaattcaaacacatccatgtagtggatgacatgttgcttcacccaaatgcccctccaggacccgggctctccttccctcaggcaaggtacctctctcatagatctattgtgagggcaagctgggatgacatatggattttacacagaactagcacaggggtgcaacaataacatccaccatgctttaatacacctcatgttatacctaagtctttggtcaaatggccttttcgcaagagaagggaactttcagagaatttccgatttgctcattgttcctctgtgccttggtcttagcgggggcttgtgacccatgtctgcagagagagagagagagacccagtggcccaccagggaccaaactaacccagcctcagcttggaagctatggaaggccatgcaatatcaaataaggtgcatcatctaagtactttgcaaactacattctttaaaacaagcttattttccagtgaaaaatagtcaccccttcttgtgataggttcaataaactacgaaactcacttgcaggtactttgttgcatgttcagccatctgaaatacatgccagagagcatctgaggaagtgaaagacttcaaatagcttaaagggctacgcaaattcaattactatgttaatagacaacatggcttccatcatttagaaaggaaaacaggaagagtataggcccatgtatggtacaagttgggctgttctaattaaaagaaggcagcacaaaattcccaagagttatcaagggatctgcactattattattaactttcaccatcattggattgcagtacatagtgcatatatacaccttgtttgactctaacaataaatcctgtgtccagctttcagataagaaaattgaggtccagagaggtgaagcgaccagcacaatgttgctcagctaacagtaccatgaagagtttggggtcggaacccaagcacatgctttctccattgggggaagagtgtctgcttaccagagaaggctcatgaagccctgtgcagtgtggtcccactcagagcagatgttgcaatgtcagctgctgagtaatggcgaggttctgaataggtgagcatggtgtgtccctggggctctgtgtgtgagaaaggtcttccaacactgcactggctctcagaacctgaacctgcatcctggagcctgaacccttgttctgcggcagcagaatgccctctcagtttgaccgtgtgtctgttggccaaaacgctgaaagaaatgtctgcaaacagaatgtctcaaaaataggtaggagatacgattcaaggcacccatgtagggtgtgttgaggctaactcctctccagacttctttgtcttgtttgatctctgctaggacactggtgcatggaagatttggcaatataatcgtaagtgttgacaaattaagggcgactaccaggatttgtgtaaattacacaggatgcttcaccatacctcccaacataataaaaataatctatctcaagcaaacatagcttcattctatctcaagtgatcctcattttaaaatgaggaaactgtagcccagagaggttaagtaacttgccctaggtctcacagctacttaggagcagaatcacggtttctaacctagatttagactccacatgtcaaatagattaaaatgaatatccagggctgggtgcagtggctcacgcctgtaatcccagaattttgggaggccaaggtaggaggatcacttgaagccaggagttcaagaccagcctggccaacatggtgaaaccccatctctactaaaaacacaaaaattagcctggtatggtggcgcatgcctgtaatctcagctacatgggaggctgaggcaggagaattgcttgaacacaggaggcagaggttgcagtgagcagagactatgccactgcactccagcctgggcgagagagcgagactccatctcagataaataaataaataaataaataaataaataaataaataaataaataaataaaatgaaaatccaggaccccttgcaaggagaagagtcattaaaggcagctcgagggtggtggaaggaggtggcttcagtcctgcccttgagccttgttgatggctgttccaaggagttggcattttgttctacagccctggatctctgtcaggccacatctcccttctttcccatgagtagcttctctgaatgactcccaaccaccagcctcctaaaacaatgtttcccaaagtatgttccatcagtacagtgcttctcaaactaaggtgcatatgaatcaccaggtgaccttgttaaatgcaaattctgattcattcattctgggctaaggcctgagattctgggaactctaacaagttcccagtgatgccagtgctgctggtctgtgaaccaaactttgagtagcaaggtaccaatagtgctttataataaaaaggatttgcaggcaaatacaattaagaaaggctgaaccaaacaaaaataaatggtttcattacttcaggacttctcagagcctttaaaatgctaataagcattattaatacccaagaggagtaagttgcaatgtgttatatgtgagttactgatgtaaccagaatgctttgatatattggtttgcaaagaaggaacagaaaatcaggaaaattctgtgcctttttcccaccttactttggttccaatgctgcaattctagctcatactgaaccccaactcagcactcccctctttcccattgtctcctttcaggtgtctgggtacatgcctgtctcctccatcagaccacatacttcctggcacccctactcctcctcccttccctgtcccagcacaggctctgtactcagaaagccccatgtggaatacctttcacagacacggacggtccaggcagcaatgatccacagagagatgctgaacacgagcagcacagtgccagggcagatggtcatgagcgtcttcatgacaaagcgggtgttgaagttgatcttgttgagggccccgatgctgcgggacgaggcatcggtgaagagcttgctgtgcagcagcatgactcgggcgatcaggtacaggcgcaggaacatggggatagacaggatgatgtccacatcggcctccgcccgggagggtgtgtaggagaaggccaggcgtgccgtccagaagaacttgtactcgccaggaatggggtggatggcgcacaccagcatctccaggctgatgtacaggatgcgctcgtaggtcatggctatccgccagtcatccgcgccattgtcgatcacgaagagctggtgggagcagaaagtccattagtgtggccaggaccaggaagcccacagcagggtccaggcaggacaggtggggcaggctggggcaggctgctgggctcaggtcagcctgaccacctcagcatgctctttaggggccttgctatgtggcaagagccctgtatgtggagtagggagagctggattcagtctacctgggaagccctggctaagacactttgactctcttggcctcactttcctcctctgcaaatcgctgcctgagatatagtgatttataataagaaataatgtacttggtctttatcctggtttaggcacagttcccaaaacgctcggaatttccaaagtgataagtgtcatttgtatgctaatgagatgactagtggctggggtcggtcggggtggggatccagggtggcctcaggatggcgctggttgccaggggaaccaatctggtgatgagagggttggaactttcagccccaccccaccacctcctgagaaggaagaggggcccgaaggttgagttgatcaccaatggccaatgatgtcatcaattatgtcggtgtaatgaaacctccacaaaatcccaaaaagacagtgttttgttttgtttttttaacttttattttaggttcaggggtacatgtgcaagtttgctatataggtaaactcgtgttacagagatttgttgtgcagatgatttcgtcacccaggtactattgggtacagtacccaatagttattttttctgatcctctccctcccactctccaccctcagtgtctgtcgttcccctctttgtgtttcgatgagcttccagatagctgcacacatggaggtccctggacacgtggagtgttgcgtgcccagagagggcatggaagctccaccccttcccatgcgccctgccctttgcttcgctcccatatggctgctcatctgaatcctttgtaaggtcctttataataaaccagtaaatgtgtttccctgagttctgtgagctgctctagaaaattaatgaaaacctgagaagggcgtcctgggaatccctgatttatagccacttggtcagaggctcagataaaacaacctggggctggtgactagcatcggaagtcaggtaaatgtggtgggactgagccctcaacctgtgggagccaacactaactccaggcggacaatcaggcttgagttatattgcaggacactcagccagtgtccattggagaattgcttggtgtgtgggaaccaccccctcctttttgctgaccacaagtgttctatgttgagccacttcccaaggtcccttccagcacacaggtgccaaattggctgtttcacgatggtgagaaagatcaactcatttatattagaaacacatccctgagcccctgccagacctgagctgagccctgtaaggggatgtaaagatgaaaaagtcatgtttcctgcatgagtgaactcacaagggctggcacagattccttctccccactcagagaagggggcagcaagtgtttgctggcagcactgtgctctcagacagtgcagtgaagtgttcacggcacggactctggagccagattgcctgatcctaacactactggctccatgatcctgggcaaattaccgaaccaccctgtgcctcagttacctcatctggggatgatgataataactgctgcatagaggtcactgtgaggctgcagtgggttcgtatatgcaacatgcatggaatcctgcctagcacccagcacactatgtaactattagctattcttatttgtagcattattaatggatctggtctcggtctttctgtaaaatgacagttgggctcagtgatgtctaaacttccttctggccctaaactttcacgaagatgcttcctgctgtcacctcatgaggatggctgttctcacaagaattgactgagcacctgctgtgtgtccagcctttgtcttccggtaagtcccactgtggagtcccaccatatttgatgactgtgaaagggacttcacatccttcccctctggggcctcagtcttcatctgagactgaaatgagaagcctctaaagtctcatccagctccgatgatttgattcttggagggtgaggcctgagatccgggcatatgttcggtgtgggcctcctgtgcaggcacctcacttctgggaggtagtggaatgtttatcatcacactatgccctctctttactgggtccttggccctccagcagatctggctgttgcctgtcccagctcatccacgaacacatcccactcaagactccagcctcacatgctgcctgctccaccaacagccacagagagctgctgctctccaaagctggttatgattgcctttaaggaggagctagcagggtcctgtggcctaacatgagctcaggatgaagggtaccagcatcagcacctcctggctgggagagcaggccatgcatgcatcctgggaaggcctgagctgcaaggccggaagaaactaggctgggttaggagaaattaatgttggggccagggttgggtggaggttttatttaacctggaaatacaccctcagcacagaaagcgtaacagagagactggatcagcgtggatttgcgggggctggctgaaagccgagtgaagccttcctttcctcccttgcacagggagatcagggaatgaggagccctttattctgtccacccaactgtctccttgatggtctgggccaaaggaagcttctgctctgcttcaaagttagtcaccaagcagctttctcactccactttgctgccttccttacagttcagcaagaactgaggacccaggagaggacctatggtaccaggcctggtgtggtgtgggcgggcgatgcttgccttgcttttagcatctacctgtgatatgtttctgcagcaaggggaacattccaggcaattcatgggccctgagaggcacagacaggggaggcagcactaggaggcaagtctcttaccttgccgagcctcagtttctctttctccctgctccgtacccttacagagccatactggagagcagaggagacaatggattgaaagggtttaataaactacaaaggatcatttgttcattcattcattcattcaacaaaaatgtgttgatggccctctgagcagccagccccccacccacccacccatgaggatcctgaagggaaactacagggcactatgggagcaactggctgagaggctcacctggtggctctaatcagggagctgtcatctctgaacaggagacagtacccagcacagcaccagctggagactcaccctcctccttccccagtgcagctgagcctgggtttttccagacataggttttccccagcaattagaaagccctaatggctgctcaaagggttccctctgcttctaactgccgcccgacaggccaagccatggcaacgtgactgcctggccaaactcttcaaatacaaaattaaaaccatctactccgtaataaagaatcgcatctggttactatagtaactgggttcactctgggcaggaatggaagcaacgagtaacagattcctttgattgcctgatgaggagtgggattgtaagtaagagctgaaggggagaatgcaccggcagctctgcccagcgagacgggagggtgctggtccccagctgcctctcaggtgccccgccttggttgtggcttgctggtgcagggaaggtgggggccacatggggtagtggagctggaggtgggagagctagcctgaagtcccccacatccaggtattagccatgtgatctcaggccgtgcgtgacttctccgagcttgtttccacatctccaacaggggaacactgactgaccttggccctgcctgcctcctggggttagtgttaggatccaataatacagataaaaagttggacagtgctttactcactgctctaaaaatgtgagggattattaagctggctggcctgggggcactcgtaaacagtgtgtgtaaagagcgggtgttttgagtagggggtgggggagagttttcaggctgcaggttaaaagcttctgctagacagggctccgctgcaaggttttctgcatctgcagggtgggatgtgtcccagaagatcccattgctgtcccacgtgaggacactctatgcttccttccttctgacccttggaatcacagctctccaagtgtggcctcgctccctcccgattcagagcaagtagcagataccccaaccctgctgtttcctcactctgggtcccattcattcctaacaaagcacaatcccaattattgatttgcatgtgtgaggttttgctgtctctccccttagacatggttctcaacctacttgcgtcgcacattagaatgacttggagggcttgttcaaaaatacccatgcccaggcccaggcccaccccaggccaagtaatcagaatctctgggggtggagccctggcacgggtgttcttcttaaggctcccaggtgagtctaaaatgtaaccagggttgggaccccccaaccagtcacagttggagctccaaagagacaagcgctgtgtcttccttgttccctgtggcatctccagagcctagcccagatcttagcacttagtaggtgttcaataaatgcttatttagtgaattagtaactcccacttactgcgtgcccctggactaatcttccctctcttgggctcagcgtcctcctctgaggaatgagggaatagactagacaatccccaaggtacctcctgctctaagaagccataattctgtggttctacacagaccctcttgctcgcacctcctgcctcatctgtgttctcggtgcacctgagctctccagggacaggaaccgtgcctggctcatctcaccccactcccatgcctgagacgttgcctggcacagagtgggcagtcagtagaatcttggtgaataaaggggtgtgtaggcggatgactgtgtcatatgaagaaaaggacagattgcctgtggcccttgttaaccacccagaatggaaattcctgttgaaaatccattcctaagcctgtgactcacaaaggacctgacaattcatctcacaccatgggaagggacaccctcttattcccaaagggtggttcaacctggaataaactgtcccaggtgacctccaagccttagaaagttctagagcaagtctggaaccaggatcttgagtagcactggaccagaggggctcggggagtgtgtatgtggctccacaaaggactatcctcccctagggcttagtctcagtcatccagccctgattctagaccagcttgactgttggcctctgatggattctggagaagtactgaggtgatgtggacagagtgtggcatggggcagggagtaccgtgggccctcaagtggtctgttctggcctgttccagagcaggagaagccacagaggcccagggctgacaaacgagtctcttcctgatgaggcataggtttgctccttgtactctggcttccctgaatgggaaaaggaaagccacattcttcgagtcactgactctttctgcctcctaagcctaaaaaagtgatttcactcattgagggtatgactgacctgaagatgcaatgtgtcagtaccacagtctctggtttcctgaaaattccattctttcctcagatagttgctctgtccagaggtggctctaggcctaatccctctaccacttaactggtggttctgagaacttgccggattttcagccgttagtataattctgagagctctgggagggagattttatgcaacagtgattccaaactttcctttaaggagcttgtaattagagaaaaaggagaactaacccaactcagttcaatataataattattaagaatcaacaaggttaggccattgtgggtatataaatctgaatcaaacacatgtcccatgaatcagtgcacaatctcaagtagttctagcaaaagacatgcatgattaggatgcaatttgaaaagcttcttgggttacatagggcttcagcagcgcccggaaggcatgcatcagacacaccagagggggcagcttgcagaaaaggccacagattcctcccatcccattcacttacttctgtacatgtgactttgcctctcttccaatcaagaagtacagcctatttctctctccctctctctctgtctctttttttttttttttttttttttttgagacagagtttcactcctgtcacccaggctggagtgcaatggcaccatctgcctcccgggttcaagcgattctcctgcctcagcctcctgagtaactgggataacaggcacccacaaccacacttggctaatttttgtatttttagtagagatggggtttcaccatgttggccaggctggtctcgaactcctgacctccagtgatccacccaccttggcctcccaaagtgctgggattacacgtatgagccaccacgcctggccagtacagcctatttctcaatcccttccgtctgaacttagccatgtaccttgctttggccagtggaacattaaaaagtgtgatacagcagaggtttaaaaaatgtcatcgccatgaggctcactatagacacatggcctcactatccctttcaccccagcctgcagccagtaccagctgccagccatcagaagccgtcctagaccagctgcatgacagaagctcacccaaggtgagaccagcagaagaaccaccaagctgagcccagcccaaatgactgacccacagaaacgtgacctaaattattattttaagccattatgttttgaggtgctttgttatgcaacaaaactaatatataacaaaactaattcttatatttggcacatattagaaaagccaggtcatgtgcctactgtgcccaacattttccttttagattcttatgccacagcccctagcaggaaccctcacccgtccccaccttcccactccactcagttatatttgctggccagtccttctcaagtaactgggtgactggatggggaggagatcagggtcaagggccattccttgatggccattcccccatccccactctccccatggacacatgatttgagatatcaaagaataactcagagcatttaaaaagttattttgcaagcagtttagttgttttgcatacaaagtgttttctcagatgtgaggaagtcagctggtagactgaatcagggaacaagggcacaacagaattaatgggcaggggggccgctggagaaaaacagcagggagtctgggagcagtggaccttgttggcaaatgctgagggtaaatggattcgctggcagctaacaaagaggtcagcatggcattccatccttggacggccagcgagggatagtacagaaagcactttcagttattcagggattcttcagaagcccttggctttcagctgtgggtgtgtcacaggccctctcccttgtcacctgcacctcagggagtccaggtctgacctttccctggttagagtgtctcgccaagcaaagatgtcatcaccagctcaccacaaggccaacgctgaaggccatctggacacctcaggacagggccgttcagctgcaatctctgcagggcctgggacaggctgccttgacaaggagacaaggacactacccagtgcctccagcagccacatggcacagcccgagcttcagacttgcgaggcctccccacatttcctgcaaaggggtaggcatgcagggaagcttgccttttttctttttttctttttttttttttttttttttttttaggataagtttagagtcgattcattggattcactcgtttttccccccattctattttgaaagacttgagacctttctgattttttatttaagcaaaatctgtcattaaaatgttctcagctatcagggaggagagcgtattcctgcttagacactttctgaccaacctgaaaaactttcactcttgcacaactgtgaatttctctaaattaaaggagagaaaatggaaaaagcctttttgtgtactgttctctctctgtggggagaagaacttccgggaaaatttccatcatttaaaaaaacgacacagaaacaaagcaagaagaaaaaattacagattttcttaagatatattatttatatatatgttttatattttatatatatatatatacatatataaatttaaacaccctggagcatatattctgcatgtacaccattactacgggggttaccatggaagcaacatcaaaaatcctgtagtacctaattaggtttccctgaggacaggagctgattgccagtgacgaaatgaacttctgggtttgcagcaatggttggtaaaattaccagtcagcaaatgctccatggaactagaggaagaaagggaggcgggtgggggttgggaagcaaaggtggaaaaatggtggctctaaaagaggccagccagtgaacaggccttgtcagggaagtctatgattctaccataaacaagatgcttagggcgttggggtccacgctaccccgctctgtgtctaagaagaaattgtcctcatctgaaaccatcccactccctgggccatgtgtgatgtcccacagtggctctttggtccggccaggataggcttctcctgagcgcttcgccagagctcacttttggtctcttgcagtgtgtaatgaccactcatgggggttatggagtctgaagtttgtttgggactaacagagaccagtggtgatcataaatcctttcccctgtcctcagttctcagagaaagaaagccaagtttcggcatttgagcgagccactattttttactcacgtagcaggaatttcttgatccctgagcacgtcaccactagggatagagcatcccacctctggccatctgtgtgtggcaagtctctggacctcagattcctcagtgtaatgtgaagacttggatgcaatttgtggttttccattttctctgggctgtggggccatttctttcataagatttttcatgtacgcccaacatgggaaacagacaaattcagagctgttgtagttgaaagggtagagaagaacattcaaagatcaactcactcacctcctcctccagcctaggtctctgtagtggaccccatgctctccatagaaccctttgactggaaatcctttggatggaccagctggtctctagttgtaaggagagacaaggtgtgatgctggaaatcaagtgtttggggtctggttcaagaggtgctcgatgcacaggcagggagctttgccccgatcagcttattcactcattcattcattgagcatgagttgagcccccattatgtgacagtccttggtaagctctagggatatagcaagacaagtagacaaggcccctgtccccacagagcttacatttcaggggaggaaaacagatattaaacaggtaaaccatttaattttagagagtgatgcctgccaggaagagaataagacagggcaaaggaaatgagagaagtcccagacagccaggacagggagggctctctatggaagggacctctgaatccaaagtgagccttgcaaaggtatgcattacagaggggacagcatgtgcaaaaaccccaaggcaggatggagcttagagagttggagagataaaagaaagaagaccaatgtgagaaagaagtgagggatgataccaggtgagaccaagaaggtagcaggacccagatcattgggaccttggatgtcacagaaggagcttcctcaaaggacaggagaccacagacccactcccaccagggccatgtgcaccatgtcaccactttctgaaaacacactgcccacaggttaaatatgcaccacagctcgggcctccgaaacaaaatatcatagactgggtaactcaaaaaacagaaatgtattttttcacagttctggaggctggaagtctgagatcagggtgccaacacggtcaggctctcttcccggcttgcaggtggctgccatctcactgtgtcctcacatggcagagaaagggagagggatctctctttttctcttctcctagagctgcagtcctataggactagacctcatccttatgaccttatttaaacttaattacctcccacagaccctttctccaaggcagttacattggaggttagggcctcaacaaatgcgttttggggagacacaattcagttcatagctattcccttttgtgtcaaaattacccaaaagccagactgtgggccgagccaggtgattctgcacataccatttcattgccatctcataatgtccctgtaagggagtcatacatccatttagcagatgaagaaacccaaaccaagacaggttcaatcaattgcctggggcttgcagcattctgtgtcttccaagtcccacgccctttcacctgccagcctgctaagcaggcactctatttgggggctggccagtttgggctttactttgtcttctaaagaaaactcggctgggcgcggaggctcacgcctgtaatcccagcgctttggcaggccgaggcgggcggatcatgaggtcaggagattgagaacatcctggctaacacggtgaaaccccatctctactaaaaatacaaaaaaactagccgggcgtggtggtgggcgcctgtagtcccagctactcgggaggctgaggcaggagaatggcctgaacccgggaggcagagcttgcagtgagtcgagatcgcaccactgtactccagcctgggtgacagaacgagactccatctcaaaaaaaaaaaaagaaaaaagaaaagaaagaaaactcaagcccaccctttaaatgctcattctcagaagaatctttgctgaccagagaatcaatatatgattaaaataaactgggttctatccctggtgtccacaccacctgggaaacccacatcgttatctgtaatctagactgggctatgtttgtggaactaagaccacggctttcatttccacagatacaatatccatttatcatctttcccttcctcctcttcccgccagtgaacaggcctctatggagacctggtgatggggtccctagcgaggaagagaccatcttagtttaggagcccacttatgcaccccagcatgtttgctaatgaagaagattcctctggacaggcttggggtggggtcagaggagaccaacacagggcttaatatatgtgccctagaaatgaacaggaacactggagatgggggattgtgagctgtgggactggaaggagaggggagctggctaagcagcaccttgggccagtcccatgagagggggaggccggagcccactgaggacttgaccacccatgagacagggacagtgctgagactgtaagatcaggagcatgtggcgttcagcgctgtcttatctgttgtgccaccaccacctcaccccttccccttgctccagatccatggaaatgtcagctaacctagaggccttggtcatgggtccctcgaggagcaacaggaacaggaagggtgcctaaagcggttactaagtacaggatggaggtggagaattcagcagaaagagtttggcatcagatgagctgtcaagagagaaatggaagtttccaagcccccagagaccagtggaaagacaccgggtcccctcctgtgtggggtgggagtttgtaaccaattatatttgaagcagtaaggccaagtgaccccggccaatccttgggttgctgtggccacaccttggtctcatcatgtgctccaccccagccatctttacattgctgccagagcaaatgttctaaaatacaaaccaaatcatgtcacctccccttctagaacctttccgtggcaacccagagtgtccaccctcctagctgcacttggccaaaagggccttttcccacctggcaccagctggcccctctatccccatcacctgccacacccggtgtctcatcccagctaaaccaagttaccagtaacccctaagcttgcgcccttccatcttctgtacaagcactccctcttctcagcttcttcaccagagacctccagatccagcgtcccacccttccacaggcctaagctggtcccttctgactcccaggtggggctgggtgccttcctccagtattccccaggccctgtgccccctgcttgtcacagagccaatccccaaatggcagctggagaaggatggccagacagttggggagtgctagcccccgtttcagggggcggagggagcagggcggcggtctccattaacaatggtaacagcaggggccatgtattgcagcctcactgtgcaccaggtcctgtgctgtgtgccttacaggcaccatctcatttagtccttaacaggattttgagacaggtattcttatttctattttacagacagggaaactgaggctcggagaggctaaataatttactacaggtcatacagttaataaggggcagacctaggctctacagccagggcaggcagctctcttgactactgtgtgtgctgcccccaggctgtgctaggaaggcttgttgggctgagccccagtgtttgcctatcccaggccaggccaataggtgtttctggttctttgtgtgccttggcagatccaggagtcaaaggtttctgtgcatctgctaagtctggggtaagaggtatcgttttctcaacaggaagtttctgataagtttctttccttttgacacatgaaaggatcctgctgaatgtttgggggtaggggaggaacagcatcatcactggggctgctgggccctgattggttctaagtcacctgtttaccactaagggagaaattctttaaccctggcttaggggatatttttagcaactaaaaataaataggtttttggatctttgaacagcctagggagctgaagaactgaggtcaggaccaggtggtggtggtgggcagggagtgtttgttttttccccaactgactaaaaggcccttcacctccttcccaagggccagctgcactgtcaccccttcagggggagcttttcctgatctcccagtggcgggggcagcacttcaaacagcaacaagccatttggtgagtccaacttgttggctggggcctaagcacttttctttttctttttttttttttttttttttttttttgagacaagagtctcactctgtcttccaggctagagtacagtggcacgattatggctcactacaacctctgcctcctgggttcaagcaattatcctgcctcagcctcccgagtagctgggattagtacccagctaccacgagtagctgtgcaccaccacacccggctaatttttgtatttttagtagaggtggggttttgcgatgttggccaggctggtctcaaactcctagcctcatatgatcagccatcctcggccttccaaagtgctgggattacaggcatgagccaccacacctggcctcctaagcacttttctttacatcaactctttgagtctcacaatagccccataagaaaagtgaacatcccccagacctcatagcaactaagtggtggagacaggatttaaaccaagaggccacactctcatctattaagtttccattctggccgaaacctccttcttgatcgtccatctgagccgcattcctgtccacctgcttgtcagcaccctcactaaagcaggggtccttgaggacagacatctccttggtcactgtcctccacagtgccaggcacagcgcccagggccacccaaatgaatacataaagggtttaaggtgtcaaaactatatcaatgtgactgtaaagaaatattttaattgttcaccatttttataatcctcctaaggcaaaagagtcttttgtaacatatgcacaagatagaaaaagaaatcaaagaatattttaaaagaactgcttattataattttttaaaaaaccctggaaacaacctgaatacacatcaatagggaaacagctgaatatattatggtactcatactggggaacattatgtagctgtttttaaaaatgaagtggatctatatgtattgacttagaaaatgttcatgatatattgctaagtaaaaagagaaacttacagcataatgggtatagtgtgattcctcttttttaaaaaagcaaacaccaacacataaaaacaaaaatgcccatatatgtgtatgcatgttggtacatttttgtataagcacacacaaaaggtgcattaatcacctctggctaaacactaaattgttaacactggtactactggggacgcagggagatgggaatcagggaacctattgatttttttccttttgataatgagaacacacctctgtgttaaaagaagcctatattgcttttgtaatttaaaaaaacccaataaagtattttttaaaagagctgtcatggagaaagccacttgtggcgcctaatggtgatgttttaagcatggccattcttggaggaaaaataattgcccaggtcctttcctgccctgtaattttctgtgtagagcttcaaatcccctgggagcccccaggattttatgaatacagccctgctagaagtgttcatagctgagctcctctcacaagtctccccctccaaggccagcctcattaccagatccacagcccctctaactaagccaccttgtgaaaaatacttccagggcatgaagattaaacaaggcacttatttcaaggccacctctccatgtgaattcctatcgtaggcactgaaagccgcgttagtcagtggcccactccgctcccccactgagggcagaggcctaggctccctgtgggaagtggtggccctccccacggttgagaaaggaaacctgctccaccattccctccatttgggagggagggaccagggccagggccagggccagggccagggcatgcggcagccaccatcaccacagcgactgctgctggtgagaggtcactgcggatctggcctcagcgtgccaggtacaatgccaagacccgtggggtacagcggagatcaggatgcaagttcctgatgaaccaggagcttagaactgcgtgtctgctagagatgcgcagaagcaaacaaagatatggctatggagagggccagtttggtgactgggggcactatttgcaattcggggtctgtgctgctgtgtgttcaatgcccacaggtactgccctggatccagacacctggagctctggctctgggtcccccacactagagggccctgcttgacccctccttaagtcacaccacaccccgtggagtcagaagcccacagggccaagaggccttgtctgcctccaccttctaaacccccgtttggatatccagacgcccagagtcccctgtccaaaaaggccccaggcctgcttccagggcccacgctgccactttctctgtcctcccataggctgacgctggctgctggtaggtacatccctaagcctgagaagcagccaaggggtagctggaggagggggcaggatgaagtttagatctgagggctgtggcatccacagtgccctcagggtcttagattgggtcaggagggaggcaagagaggggcatgctagggtctggggcctcagggtctaggcgcctccactggaggctggcccaggccctgaaggaaacagggatggatgggcctgtcggtcaccctttctgactgtctgggatatgaatgacaggagcagcagcagctgcattttctagttagttctgaggtcaggcaaacaggcccctgacactgcctctcagatgggttgtcccaccttcacacacctctgtagcaggcacaggtatacaggcttgctctgaggcgccttctgccgagtgctggccatgttggaagcaccatacaaagtggttgagtggccaaatgtttgaaaaatgcttctcagagattcatcaggctcattagcatattaaagcttctgagacttctaaagaaaagaaaacaagtcggctttgaaatgcagtttctcaaacttatttgaccttgactcttgttttgaagtaacagctattaatatttcaaggaacactgggaaatgcagggtgtgaggcattcagtgtaacagacaatggagggttcattccttcaagcatccatggttcattttcatgaagattaccatagtcttcctgagaggcaccaaatactcccctgccttcctgaactgactccacggagcacagcccacgccgccaaacccgtcagcatccactcgcatcaccccacagcctcctgtgagccagccaccttcacgtgctttttagttattttatttaacaaatacttaacacagcgtttactaggttccgggtgctagtctcaatgacttacacatactagcttctttactcctcatagcagcccttttgtggtgggccttattattgaaagatgaggaaactgaggcatgaagagattaagtgacatgcccaaggtcacacagctggtaagtggtttactcagacccaggcagtctggccccagagtccacgtacactcatttcttattgctgctgtaacacattacttaaaacaacacagatttattatattacagctccggaggccagatgtgtggaatcagtttcactagactaacgtggaggttgtccgcagggctggctccttcccgaagatcaggcgggggaatccgtttccttgcttttccagcttccagagagggcctgccttccctgcctcgtagcctcttctcccaccactccagcctcctgcttcaccatcactcgtcctgcttcctcttcggtagcttcctctgcctcccttttcacaaagacacttgtgattacgtttagatcccacctggataacccaggatactctcctccatctcaagatccttcatttaaccacatcctgcaaagtcccttttgccaggatatccagggattaggagctggatattttggcagggtggtggtcggtggggcaggggggggcattatgattcagcctaccacattatgcttttgaccattgtgctaaatctagtttaatcttcctaacaatcctaggaagacgttgtcattatttctattttacagatttgaagactagggctccaagacgtcagctgaactgccaagtgtcacccaggtagtaaatggcacagctgggacaggaaccaagaagtgaatgacttgctccttcacacctgccctgccatcggagaggcggcactcaggacaggcagggccttgggggattccgaaggaggtgctgcttttgttactctctagactgagccctcctgacatcctaagcccactgaaaacctgatgcgagctatgaatttgctttccctagaacaagaagcatttacagaaacacaccatgtattgcagctagtttctgggagttcacgggccccaggttaggaatgcttgctttttttgtttgtttgtttgtttgtttgtttgttttgagagacagagtctcgctctgtcgcccaggctggaggagtgcagtggtgcgatcttggctcactgcaacctctgcctcctgggttcaagcaattctcctgcctcagcttcccaagtggctgggactacaggcatgcactacaatgcccagctaattttttgcattttttagtagagaaatgaggattcgctacatatatggcaacatatatgttggccaggctggtctcgaactcctgatctcaggtgatctgcccgcctcggcctcccaaagtgctgggattacaggcgtgagccaccatgcccagccaagaacacttgcttttaaaagcagagtatcaaagggatgtttgcacacccatgttcattgcagcattacagatactccttaacttatgatgggtcacgtcctgatgagcccgttgtaaattgaaaatattgtaagtagaaaatgcatttaatacacctaacctaccgaatgtcacagcttaacctagcctgccttgtgtgctcagaacacttacattagcctacatttgagcaaaatcatctatcacaaagcctattttataataaagcattgaatatctcatgtgatttactgaacactgtaaacggtagagtactgtatcagttgctgaccctcgtgatcacagggctgaccggggctctctgccgctgcccaacatcacaagagaatatcatgccgcataccactagcccaggaaaagatcaaaattcaaaattcaaagtacagttcctgctgaatgtgtgttgctttcacaccatcataaagtcgacaaatcttaagtcaaatcatcgttaaatctgggactatctctctctgtaggattcggtactatctgcagttttagacatccaccagggatcttggaacacatcccccatgtatatactgtacagaatttcaggtttgcaggagacaagagttctggagattgtttgcacatcaatatgagtaaacataacatcactgaactatatacttaaaaatggttaggatgaggccaagtgtggtggctcacgcctgtaatcccagcactttgggaggccgaggtgagtggatcacctgaggtcaggagttcgagaccagcctggccaacatggtaaaaccccatctctactaaaaatacaaaaattagctgggcatggtggtgcatgtctgtaatcccagctactagggaggctgaggcaggagaatcacttgaacctgggaggcagaggttgcagcgagtcaagatcgcaccaccgcactccagcctgggtgacagagtgagactccatctcaaaaaaaaaaaaaaaaaacaagttaggatggtattttatattacgtgtatcataccactttttttttttttttctcaaaaagactgctctaaactgagagctcttgcagagcaaagaccacatcaggtacattcttgcggctggtgctggggaggagctcaacagatgtctgcccgcgacagctcagcaggtgggatgggtgatcggctgcctcccgctggctgtggctaacacttctagaagccctgcacaccggagagtaagcaaccagcccaagcctggctaaaaccaaaaacaataaaaagcctcgagaactgagaatgtggaggaggaagacaggacaaaaataaatccagtcactgctgtggtcaagaagaggtggctttcacccattcctcaaaggaacctcgaaagggaacgaaaggccccgatgttaattttagaaatagcttgaagccctgtccaacttgagagtgactctgtgcctcttccacagcttaaagtacctggactttttgacagttgtgctcctctgctgccaaatgaatgggggttgtaatccacttgaggatcttttaaacttcactgctgtttgtatgaatttggaaggaaaaaccaaacctcctctgagagctgactcacgtccctttgggcattgtgccaggccctcagaaatcacctcatctgccaacccatctataataccctgtctgtaaaagcatccttctgcttccactggccaggaagatcgcaaaggaaaccatgtaattgcaagaaaagccaagtcagagaggcaggtgacacgtgttttatgaccaatgaggggcaaagccatagaaagttcagaactgagagtgggtgggagcataaatcctgttgccattgtggtaaaaatgggtggcactcactgtgggaaccttgaaagggaacagagtgccacgatgctgctttgcagagggtcaggtggtcacacagcatcctggggtggtttattccctccgggtctcccccgtctgccatgttccaacaaccatcccagatcctcctccctctaattgggatcatattaaatagcctttccaccagtgacagaaggaggtgggctcttagtggagcccactctgtaaatatagagtaacaacaggaatcagaatgttccactggaaacaggtgggacttgtcctccccatacagactatagaagatgtttacaggactttctgcaaccatcctcatcaagtataatcccagaaaagtaacagcaagctgatgggtttattcaggtaatatccaggagacatatttctctttaaaaggaaaaggaatttgcatgttttgttatggccatcccttattccagtttaactggtccctaagaggctctaactacagcaagagggattttggttagagagattgtcaaaccttgaagaagggtagagacggaaagagagagaatttgagggaagattcctcccagggaaatgttttcaaaatgaaatctggacctattcatgtgggagagaatgcccaccccagaagcaggggattgacctatatgggctccgaagttcttttcatgctgtttccattgagctgccttcccttgcctgtgatgcaggcagaagtttgattttttttctatccctgaaggtgttggcaaaacagaaagtttctctccttcagccaggtctcaggcaacttctagtgtgtatttccccacccttttcatttcccagccagagaaaggggagttcctttagttgtggtcctcggttctgtaccaagagcaggaagctcctaaccccaaaccatcgcactcaggaatattctcaccacaaacacctagaagccaatctttccactccaaatggagatggacaggtcaatcagaaagaacgggctattgaaaagctgtaataaatcatgtgccaagtgaggtgtcagacatgcaaaccagggaatacaaagtcagagagttgtaaatgaagtagtgggttgaagagctagcagtggcctggttctctctgcccacagcaaaggcccagagccagcttgtgcaccacccctcctcttggccaggaaggtacccaaatgtctgttccttggtaagaggctgaccctgaaaagtttacacctggagtttcatccctgtatcttaaagcaaatggggtgatggggagggatgtcgggggcatgggagggtggcagaccccaatgcagcctagagacaaagccaccaggcttgggaattaacagactccatttaaaagttataaaccacctaaaaggattaccattaatgacagtgattaatgcaaactgcaaagtagcaataaatcattaattatactttcaatttttaaaaactccaacaaatcaatattaaatcttacagaacttattcactatgctggggactgttacccaactgttgtggggggaaaggcagaaatagaacacaaaaagcctgcagtgaaatacctctaagaatggctggagtagttaacttagcttgacttgacctcgttaacgtagttgactaagctgacttagtcaaggaatactaaagacctgcagttggaaacccgacctgccccagatctccaaagtcagtgtggaggcggattcattccagggtttgcacataatctgggtgggagagcatccgtcattccatcacactggatcctttcccccatgcatgcctttgttcctcactgatgcatccagccctcgaatgtgcacagcactgtcccagggctagaggttctgcctggtggtttcctgttgtgcgtagaatgtagacaaatcctcttcccaggaccaccaaggctgttgtgctcatctccttcttgacacacaatctttccgaatgctgttccctctgcctagaatgttcttcccttcactctatgtcaagttaatcctattcatcctctgactggatcaatctaggctccttggagtacttaccacagttgtaattttacagtcatttgtgcaattatctgactaatgtctggcctgttctgaggctataagctgcttgaggacagagaccatgtctgtttctatgtccatgttttccccagagcttgcccttaaacatagatgcttaataaacacttgatgaatgaaaaaatgaggcacacctcaaaggagctcaaggtcctggtgggagagactctctttggctctccatgtaaatgactccatcagccctctgctgcaagatcagtcttgcttgtgaagaactgagtcctctgatgggatcagggaccctctgagaggagaaaaaacttgcattatagagggtagactattgttatgctctttattatctttgactattgcctttctggtctccctttgaattagtagattattcagctgtcttgaggcccacaaggaacaggcattttggtccatggatcaaccatggaccaaaggtggacctctgtggagggctcattcacagaggtgcaggagcagcagtatgcctgaggctaggcattgtgcatggaggtggcactggagggaggaaggactttgagcccatctagaaagaatgctgggatcgattggttatgtctgttatggatgcagcatgggaacccagtagcgagcctgtcacacattgaccaggcatactctgaggaggcagggagctcgttttcactgacttcctagagagctctttttcatccaatccctgaggatgtctgctctgtgtaataaggggggctatttcttcacagttagttgtcatggctggatttcccatagctgggtggttccataagtagcctatacttagttactgagacaggcataaatttaggtctttcacatttacacggaaaattctctgaaacgagtcctgtgagagaatgacatcctaacgtgcccaggaaagcagagggaccaccatgcccgtcgcccagcccctgtggtctgtgacacttgtgcagccgctggctaaccaaaaactgaaggtctgggattagattgcctttgcgtaatctgggaagccaagtcccttttctgactggcttctgaagaaagaatctggtcacccattggtaggctgactgcgtgaaagaacgcactttgcaaacataagagcacacacaggggccaccccacaaagccacctctgcagtggtagtgtcgagtcccccacctactgatcacaacgtggtaaggcttctctgaaggttccaggaccatcaattcatgtctggaagtacggtggaagctgcacatcattcactgctgtgccacacattccctgagccacccttctgtcagatgctgtataaggcatggggactcaaagaggcacgggcctggaccaccctcatataactcagtaaatgagcagtgatgtaaacagaggaatatattgcatataagaggtgcagcaagagacgtctgtatgcatgaggctccgtgggggcactgaaagttggtgggggtgggtcagggaggacagctcaggcttaagagatgagaacagcacttggaaggaggagcagtacatgcagaggcccagagacgtggacctgtggggcacaggggactccagggtaatgggcacaggggactccaggttgactggcacagtgttccaggaggaaatggcacagatgtggccgcagagcagggcagggccaattctggagggctctatctgcccccctggggagtctagactgtattctaaggacaaggaggagcagccaaaagttttcagacaaggacaaggtccagtgtgtgtgtctgttggattcctcacagctgtgacgatgaggtgaggtggtgcagaaagggtgaggaggcagggtacaagttagaggcttccctaacagtccacataagacctggtgttgggggatgagtggaggtggcgaatactgcaatcgaaaggtaatttatgcccactggaaaataccttggaagatatacactcagcagtgacggagaaagagctcataaattcttattgccaggtccacatttctccaagagtctggcctcccaggaccattttcctggtctccactccagatctgaattcttgcccctcccctggtctccatagctctttgttattagtctgtcttctttgaattacagtccacagaatatcatctcccacccgtctgggaagaggttgagggcagagctggcattccacgtctctgtatttcccattggtgccaaacatacacacgcacgtacagacatgctttcatgcacacagagatgtctagatatcattttttattgggtaaaaaaaaaatttaggtgcagggactgcccaagttacaattcatctggctgcataggctcacggtgaactagttacaaatttgtggtttgggagacaagtcatgattcaaccgattcaaccgattgtgtccgtaaagcagctgggttcagaagtgtctgaagctgggggcccctgccgctgtcagcatgccagctcaccggtcgatgtgcacagcgaacgctggccaagctgtgcaaggcactccggtggcattggtcaataatggggcaggcaatgaggcagcgcccagaggataagacacatctttttttgattgtgtggcttgttttcttgaggaatgaaagggttttccaaatgaagatagtagaatggaaacaaatgcaaaaccagaaatgaaaaaggcgtttgggatctaggacttaaatgtatctaatcccggtgtgcttgtggacatgggggtgatctgcttggcttcatcagcagcctgcgacaactagtggcctacaaaaagctagccctgcgacagtgtcatctcactcccaatgaagccagtctccgaaggagaggagagggtaagaccatctagaatatccacctcgtccctccccctagaacaggagacagagacagcagtgaggctgggctcacaggtctggccttggggtcccttaatgctcatactaatggttaccatattacctgacattctgtagtaggttgtcctaatttctgtagataatcaaggatggtggaaaaaacctggacttcggagtcaggcagagtagggttcgaattctgactcctccactgactggctgtgtgattttgggcaagttaattaacctctctgagcctcactttcctgaggagataatactgtagtacatagcgaaaggaagtattaatagaaataaatctcacaataccaaagtaactttcagaggtcgcccttgaagctacaaccctaattcatttcttcctccatgaccccccatcactgccacattccgttctttgtctgcatctgaatttacacggacttatttgattgattccttgttattgcctgtccctgtgccttcccactagcctggaagctctatgagggcagggatcatatctgtcctgttcattagtgtgtccccagtgccaggaacagtgtaagcactctttcaatttttggtaaatgaattgaatgagaaacacaaagcttggcatatagcagatgctggaggaattctgatcagtgtgaccccagagacctagaaggaccagaggcgtggacacaggggtgtggctctgcctgagcaagtctctgtaacttgctgtgtggacttttaggtgtcttctctctctaggcctcagtttcctcatctgttcaataagaaggatggtctgatgatgatcactgaggccttctccagcactctctggctctaattgtcttggatcctccacatgggctctggactaaatagaacaggaaatccagctccatcactggagcctccatttgtaactttcagctccatgactgccatactaaatcatcccgagaggccagggtacaattcctgggacagggtagatattgcaaattgccagcagcaactggtagccccacttctccactcccccaacccttatggcccagccaccctcttggactcaccaagacacatctgttagcctcagacctggtttgaacaaacaggaagaaaggaaggacagaaaataggtgggcattgacctgtaccaggccctatgccaggtgctctgacacacagtgcttgcctggtcctctccatagctcaggaacatcattatccccattcacagatgaggagaaggtatattagttatacccatgaaggcagcaaatagcgaggcaggacattcgccaagccttctaactcaaagtctcacacattgaacaatttggtggagtttacaccctaggcctcttatctctgactattaatcaggctattcccaagtgtaatttatggcaagaatacactactaattcaggagcagcctctatgggagacattgtttacactaatgtagtaataagagcaaagaaaagagctgacatttcttaagggtaatggggaccacagtgacaaacacatcacaagcattctctggttttgtccccacaaaaactcaatgagtaggcactgacactgtacctactttgcagattaggggcacgagacttacagagtgtgtgaagttacacaactaagaagtggtggagccaaaattcaaatcctagtctctagttccaggccttccatcctaccacctcactatactgtgggcagactggtgagaccattgctatgaactaacagtcaattacacaacactgacacttattgcatttttttttttttttttttgagacagagtccactctgtcacccaggctggagtgcagtggcacaatcttggctcactgcaacctctgcctcttgggttcaagccattctcctgactcagcctcccaagtagctgggtttataggtatgcacaaccatgcctggctaatttttgtatttttagtagagatggggtttcaccatgttggccaggctggtctcgaactcctgacttcaagtgatctgcctgcctcagtctcccaaagtgctgggattacaggcatgtgccaccatgcctggcctaaagcacactttaaataatgatttatactaacacagttcttattatatgatcaaactgaaaggaaaagaggtcagtggtctccagtctcagccagcattaatgccaaatggattgggtcatactgtgggattaggtcacactgtcggattaggtcaagggctcaagatcactgtcactcattggatgaatgcacagcagtgccaggcatctccgtgttctagccagggcacctctagagattatccctgtgaactgtccaaagagcgtagccagagtctccagaaaacgagggcaggctgacccgcttttggagcccacagagactttcaacccataaagtgaagccaccagggttgtgtcccctcccctgcatagggtcatgtaggaatttgctggaaatgccctagagtgcagttgaaaaggcttagctcctactgaaagcaaggagagcctccactgcctccttcctgaatccgcaagtgccctggggtggggagacctgtgcccctacagcggacagccagctgatcgtggtctggagcttcttggtcagcatggtggcctcatcccacaagagatctggcagcagagcatgggacccaggaaaggtcactgagattagttctgtagctgagcatgaaactgactttgtgctggggcaactgcagctctgcatcccacgttgggaggcagccaccccaccttttgctgcctgcatggtcctgggcaggtcccttgacctggcagcacctcagctgcctcacctgtaaacggaggccacattcatccactcacatgcaggcgaagggtgtgacgtatgcatgggaaacagcctcgttgaactgtagattcctgaacgaatgtaagggagtttgattttcttattttggatcccaaagtcatcattgtcattgtgctgttgtgatgattcattggctgtgttcttacagaatgggacatataagcagctcacttggaaataaaggggagagcttgtcccagatcacagccacagtctggaatcatgagggccacctgcccctgcttgagaaggtgtaagtttcttccttcacccatccattctatcgcagatggatttccattgctttcccaccagggccaagctcctgtgctgatattggtacacggcggtggccccctagctttgctctgtcctcacagagctgttgctctaccacaggacacagataaggagtccagaattggctcagaggatctttctggcccaaaccctcacccaggagatgggtgctcagggccggtgattgttaagagatcccagtacagagctccgagctggccttgttataacctggtgaggatgctagacccacaggaaaagcagacaccaccccaccctgagaagactgacactggcacctcctacctgggcaccagttctgatgccagccagcctgagaaagtgacttcctgggggcccattaagcaggagttccttccctagactccaggcttcaccgggagatgcctgttaggaggaaacagattaggactgtatccatcaccaggtatggtacctcacgcctgtaatcccagcactttgggaggccaagtcaggcagatggcttgagctcacgagtttgagaccaggctgggcaacatagcaaaaccccatctctacaaaaaatacaaagattagccgggcatgattgtgcgcgcctgtagtcccagctgcttgggaagctgaagtcggaagatggcttgagcctgggaggtggaggttgcagtgagccaagatggtgccacttccctccaaccagaccttatcccccgctcaaaaagagaaagaaaaagattctatacaccaagctggccagtggactccagcctccgtcctcctttctttaggattctgggggagatgaggaaaggaggtgggggggagagcctcacccccaacacaggaggccgttcaattttacctggaaagccctgcttcttttctcactgtccccagctaaagggaaccatttatcccggcaaagtagaagaaggccgtttgcattctgaaatgaagcatcagcgtgcaatgacagttaaggtcccaagatacccccggagtcactttttattcttttctatccacaatcattaggggaaaatctctctgcagcttctgtaaaacccattcactagagggaaatagatcaatgagaaagccagagcccagagagcctgtgctggcggctctgaagcaagaacatccattcttccccaagagcctacgccaaaaggacaaaggatgctcgctcccaccccctgaaagaagagttagccaaaaaagttctttaactaggaatctatttcttatcctttattcagtaagaacaaaatctctttctgagagtgacatatcttacacttcaaacaagtgcaacttttgccacttatttttaagtgcgcttgcctgccaaagggatagcaggaatccagggggaggaagaggcaagatggtggaggcacagctgtttccatagctggcatctctagccaacagctgcaggacctggaagagcttgaagagctgacacccccggaggatgcacaaccccggagtgaaagactcggcctccggggctctgtttgctgatgtcagcaccaagtcggggcgcgccaggaacgctctcagcagtctgatgggagtgggcatgcaggcagcagaagaggaaggggccaacccacaagagcaagggaataagaacatggcctttgttcacttgtttcttgattggacaattattagcacttactgcatgcggggcactggcagtaggggtgagatgaaataataatagtaacaaaaacaatagcagctaccatactgaattcctaccctgtaccactgctttctgagcattatttcatgtaatgggcacagcaacccctttaggaaggtactgatattagatgaagaaactgaggcagagaggtttaaacaactagtccaacagctaataaaaggcagagctgggatttaaacgtggatctatttgactcttggctagagaaagacaaatggttgatgtgggcttactgagcttctcagtatgagcaaggcaccaaacctgcatggagctcaagccactaccccgcacccaggagctcactccagagccaggaaggaggggagtttgaaaaaacacagggagcaggggtgggtaagatctattctcaccccaggtgttcagtgacctcagggcagctggccaggggcagggcccaggaagtatggagcccagccctgctgtagagcctgatgtccaagctcaggggctcagcattatccagaaatcaccagatggtaagaaatcaccagtggtgaacagaggatgacctactcagtcatggtttaggaagaccaacagctgcagactaatatggataacccaagaatatgaggcaaaatacaatttctacactattaaagaaaaaaaaaagatccattcatcaaaaccctccagccagggctaggcatgagacttaaccccagggacctgaatgttcccacacagctccacctactaacatgggtgtgcatggagccccatccaagaggcagacccacacaggcccagtggcttcggcctgggtttcctctggctgtcactgttaggctcctttcctggccatattctccagctgcaccagcctttctacttagttgttctgcctggttggaggggagaggctctctgtctttgtgagggcccttttcacgccgtgcatgacaccttcccactctggcctctctcatagctcactgaggctgtgccaagtgccttatgttagggatggagcaattcaccatggagtcacctgggctgcagctgtatgtactggacttcagactgtggccaggctttgtgaagtggctcaaaaatgcccccaggccctagacaccaatgagcctgagggccctccttccctgcccagagtcctagtgactctggaagcctagaaacaaaaacagacatttctgaccactagcagggcacagggatgggttagcaaggctttcacgcaagccccaggctactgtaaacattttgccacaagcaacactgggctgcagatgaaaaaggccagcagtatggagcaggttgctccaacagaggcagtgacactctgagctataggtcagcagtgacacctgtcatttggggatgatctggtgtcattattagctcagtaagccctttataaataaacacgttcatcaacatctgtctgccttgagacagttgtttttcttcaaaacacaaaaactcacaagcccatcaaacatttgcctgccccactgtagtccccaggcagacatgagtttgcatccttcacgtggcatattttacagttagaaaccaaggagcgttgagtcctgtttttaagtgtgtttgaccaagagggaatgggaaacatgccagggtgtgatgtggccctgggcagtgtacagctgttcccacagctgacggagattcctacagttgcccgccacaccggccagcaagctgttaatctgagcgagagatgtgtgaccatttggctggaggggacaggaaggaggcatctgcccaggcagcaaccattctctctacagagcctcacacaccaaggattcacccctccctcctttcccactcacccatggccaccttaccacatgagcattcccagaggaacattttccaatccctgcctgtgtgggcttttaagaccccgtctccccgtgcaactctgcattttccttggatgtcccttttgattgctgtcattgctcccttgttggcatgacacgtcctcctttaccaccctctgcagtggactccagccgctctctgggatgcaccttgaaaggagggtagggctaggatttgaagagactggctgttttcttggagaaagccaccccgttcctctccctgtgaggggcatttgcagcaggaactgggatgccactgacacctttcagattaatgcgttcactcacaaacactaacacaattggctcgaattcacaactcatgaaatgagtctaaggggcttaacagggtgttacagcccacagcttcgcaaatgcggatggatggcaggacaaaacgcactaagagttttttattagtgcttagaattcatgatatgccttcacgaccatggtgaatccccacatcatgatgtccccatctttattattccacagcaacgtggttccaagtcaacactgtattatatcattaattagctgttcacctatttgactccttcccttctccttaccagccctctccctcccaagaccatgaactatttgaaggcagagaacacatcttattctttcccatcctggcactgagtagggaatcggtatctgctgaaattaactgaatcccacagatctcggtgaagacaagagtagtagcaatactggtaacatgagcaaatacatagtcctaatcccttttacatatatgaaagcattagttctcacaccaaccctaggtaacggctattctgatccctattttatagatgaggaaactgaggcacagaaagctagaatcgttcaccccaagctcagtcaggaactggcagggttcggctttgcacccaggcagtctggctccagagtcagacctccaaccctctgcacacactgcctttcaagctgaactgatgcagacaccgaaaacatagtgaattacattttcaaggaaagactctatagaaatatagcatatacaaagaggacattaaaacaattctattctgcagacagccatgcaagaggggcgtgagagatgccagaggagagaatatgccccatttcccatgggagggtcctctctacacatctaatgctgctcggcacacagtcagggttcgagtgaggcggtgaagaggaaacagggggacctgggcgttcagggaaaaggcccaaaaggtgggaggggtgtgttctgggcatggtctaatcagactatggacacaattgtcaggtagggggaatggctgtggccatgggttagttcagggcaatgattctcacattctgatgcactttcaaatcacctggggagcttggaaaaatcgcctctattcaatgcctcccctgagcaattgagcaattgagcaattaaatcagaatccctaggggtgggactcaggcaccagtattattttaaagctcccagggcaattacaaactactttttctcaatccaaatgtgagaagcactggttcagagtttatgcagtattattcaccagtctcttctctgcattatgaactaaaacggtgtgtggggattccaatgggtgggctcttttgatctctacttctcccgctgtggtcggctgtttggggccattctgtgggaatgagctttctctgggtttctagggggccctttagggtagtagtagacttcagattgtgcagctccagttcaaattccaaccttgccacttaccggctgtgtgactttgggtatgtgatctaataccctagcctcagtttcctcatctacaaatagaggattgtggtaggcagaataatggccccccaaaatgtctgtgtccaaatcaccagaacctgtgactatgttataagcaggaattaaggatgcagatagaattaaggccgctaatcagttgactttaaaatagggagattatcctggattatctagatgggcacaacataatgacagggatccttaaatatggaaaagagaagcaggagagtcagtgtcagagtgatgtgatgtgaggcttcctagagccccgtgatgtccgtgaacactgcacgaactagtgtttctacttccagactctattcatgagaaacaacaggaaatggggccgttgtggggtatgggtaggagaagtggaaggttgagaagggaggcccctagggagtgttcctggtcaccagctaagaagggaccgtggacattgtcagcaaggactttggagagttcatctcaaggtgttgggtaccccacctgctgccaagaacaggcaagagctgcaccactgtgcaccagcaaagggctggatttgcagtggtgatctccttagcaaggagagtccaaaattaaagtcaccgaagtctcttgtttgtgccaggccctggtgggccctttaacccagctctctcagctgatgctcacaacatcagcatgtggccagcattatgacctgtttatacagaggaggaaacagactcagggaaattcagtgatttgcccgaggtcacccattagacggcagcagagctgagattagaactcttgattctaaatctagaatcttccatgtcataccatatttcattttcttttcataaaggcctaattaatactgcagtcattattgattcaatcctgagagcatgagaacacagccagtacagactattaatctgcatttcctccttgagatgtgccagccataaaaaatgtagcagcttcaaaaactacaaactagaaaggggcctaaaggaaatttggtgcccaatgaataaatcttatgtcagctcaggattgttgtaattgcagttctgtataatgttcataaggcttgggtttcctgcggtccctgaaatcgaccagggaggtgaggaaggaagcagccattccccaccagggtgcccaaggactcccaccaaattagaatgtggtcccagccccgggaactaaatttatcctgaaaggacatttggatcagaatgttctctgctacaagagatcctgtccctcattgtcctcctctttctcttcttccagagccaggcagtattggctgtaaaactcagccctgtcaattcagcttgaaaaccacacatacacatgcagtcaacccgcagcaacagacaccacatgtttagatttgaaagatgggaaagactgaggcaagcaggaaaggagaggccgaggacatacagagaaggtgaaacaaggtggttttggtgaagctgagcgcagggtcaaagaggaactgagaagaggaaaaaatgtcccctggtggctgtggacaactcgagcccgtaacccaacagcagctggggcaagtcattccctctacagcgccagctgctccttcccaagccacgcagctcctcctacctgcccccgcacttcaaccttttgagcccacttaacactcagaagccccccgcacaaagtcggctttgggtgatgtcactgctgctgcgggtgacagccaggccctggggatagaagcctgctctgggatggtggcggtttccagccaccccaccaaacctgcaaggttgaattctgcaggcaaaggaaggatgtaaactccctgcctgggggagaagctaagtccccgaggctgctggagaagagtgtatttttaggcataggcttgatttgtgaacaataagggaagagcaaaattgtaaaatcctaaggttcttgtgaagtctgatcagtgtcgctcctgctaaacatccaaaaagatccgacagagcaagacaaactcgggctgccctcaagccctggctcctggttgggtggtgttcagtcagtgagatcagaacctcagcgttttggggtgggaggggtgtttttccattcctctgactcttaaacaagagtgtaccaggtggctctcatctttaatcctaacaatctcccaaggagggagattcatccaccattcctctagcccaaccctgtactctaaggtcagagcaggtcccagtgattgaggggggttcaacctgtaccataatctacacccgtctcccatccccattcttacctctcagtctttgatacagactattgacattctctccatcttacataaaatgctttgcaggtgcaacctgaagacaaattccctggcttccctctcccgccatcagatcgccatcccccaaccccttctcatagatagaatggggctactaccattttagacctgggtgcctcatcgctccagctgctgctcaccaggatctggctccagcccttctttctattctcacctttcaacattccctttacgatcagctgcatgcctcccattccgcagagccctgagcttctgcattcttcacagctgctggagctggtcccttcccctagaggaccctcgacccacctgcacctgctagaactgaccccatgaccatctcagatgccctgcacagcagcgtcctcattcccatctaggtggaactgtgcgccgtgccctccacacccttgtcctcagcaccagcagccaaggcgtgtgtgtctgcgtgcttatctctccattagatcacaagcctgtttagggcagggaccttgctgtccccacggtgcctggctcagaacagcccttcaatagctctgtgctgaatgaattaatcaccttttgtccagtcctcaggggagagaatagttgctatttctaacagcagcaggaagacaaatatcgccctgcccactcccccgcctcccattccacacatacacacccactggtggcaatttctctttgctctcaaatcgatatggtttctagcacattctagcaagaagcaccataaagagctgatagggaccttggagagcccttagcttcctccccagatgcacaagtgagggatctgagggcagtgaggggcagggtctgctggcgatcacacagcaggcaggtgtcgggcggctcccgcagagccgcctcgtggctctgagttcagaggcggtggctgctctgcgcccactggatggctccgccgtgtctggttactgatctctggtttgtggctgtgcctgatgtagtcacaggtcagtggtcatagccaggcccagctgctgtggctgagcagtgtctctgagaacgtccagccacggtggccatgcctcagcactctcctgtgacacaacgtgatctcaccgagtgaccaggtgtacggcttcacccgtccatttcacagactcaacactcagccccagcagccaagccccagcaccagcagccacgctttcatttcacagactgtgagtaacacgagaccgggtccagtctgtagttcacagctctgtcccataccaggcaccgtgcccctcacagagcatggctcaataaacacgtgttctatgaatgcagagcaggcttatttgggggctggggtgggagggcacataaaactacaacctcacaggaggccacaaaacttttaagatgaaaaagatttgcaaatccttgaagtttcttctttacttctcctgtctttagtccaaccaaagaaagtttacctcccagatttgacttctggttcgacatttgtatcaatggtttagatgaagctattatactcaggctcatcacatgtgggagggcaggaagctgggaggcccccaaatacatgttgctgagtgagatgctaaaaggcctggacagactagaatgaagggctgaaacagctgcagggaaacgtaacagaagaaaatgaaaggtacagttctcacctaaaaagccaacggtattaggaaggatgggagattgagggggcagagggtggggagctgcttagcagctcatgagaagacagaggggttttagtaaatattcaattcaatataaactaacaggctaccatgaaagctaaaagtcactggctgtctttggctgcagtaacaaagtgagaaagcaggtcggtgccttctgtactgacctgatcccagtggtgtgtaagggtcagtgtgtcaccagatccctgggctgctgtggaccaagcagatcctgttcagagtagcaagatcagggtggaaacaggattattgacatgattatggcagggaagtgggggcatttaatctagggaagtcctgggtccagcttaggggagtttgggtggaaggctgctggcaccttaccataggaacgggcagaaggaggggagaatatgggcggggaaacaggaagagctgctgaagcctgactcacccaggccactggcagcccaaggcacagtgtctaagggaaagaccagactcagcccaggcagatgatggcttggggttagaggcaggtctgatcctgagggcctggggactatcagggacactgtgactccaggcgagcagaagtagaagtcagcccctcagaaggcagggaggcaagaaagaacaagacccagtatggggctcagtgaggcttcaaggaagaccctagccttccttgggatcagaaggcaaggcagagaaactgaagcgggtcccagttctgatggctgggcaggttaccctgagatggctgcccttctacctccccaagggtgctgggcctcatccttgaggcaagccttggacccaaggggaggacaatagggaaaccaggagaaggaagggattttaataggcagaggagccaccacaaggcacagccaaggtgggggtgtggctgggatgagggcctccagagctgctgcaaggttggaccaacactgggttactgttcagccctaggcttcctaatattcacccttgttggagggaagtccccatgactcagcccaccttctaggctgcttctagccattgtaggaaccaggggtagaagagttaatttgaggacgggcctctctcccccaggcagggcaacctggctagctttggagatggtcaactcaaacagttgacctcaaaaccctctgccctcaccagccacatgactgtggacacatctcttaccttctctgcttcagttgctttatctataaagggggtatgaatacagagcctaactacgggactgtcgccaagaatcactgagatgataaagtaaaggcacagtctccagcacacaagagatcaacagatggaggcgacactattaccacctgtgggattaccaaccacttccccaatcgaaacttggaatcagaaccccggcccgtgacgttagggcgatgggacagggtaaaggtaagtttaggggctgacaaagtgggagatgcttgtggagatgatgtgcgaagagagctcaccacaagccttggtggaggcacacaaggccacacagaaaatgacaaaagtcagttctggagatggatggtggtgacaaatatacaataataaggatacaaatatatatataagaatataattagacaattaacgtcactgaaccatatacttaaaaatggttaaaatgctaaattataggttatgtatattttaccacaagtttaaaaagtgttttaaatgaacaagtctcaacttggacccaggtctacggaccgcaggctcagtgtctctcccaccatcatgctaacaggacaggtttgtatgggagatgcctttggaggaaacaaaactgctcaattgaattgcatcgaattctttaattcaaaggtaaatcggggcagttcatctcttttcctcgtccaattgttgggttttggagaatttgagcagtggtgattttgccattttttctcttaaaaacaggaaaatgtcattttactagatttgtactcaacaggaaactagaattatcagaattttcttgatagcacaatgcaacaacacttgtatagaagcctccaaacactaaagattcaacagtgccttccaactttacaaattctcagagagtcaatgatccttaccccaggagtcactgagtcctactatgcacagtgctcttcgttaggcacagcaggggtggctgcagggatgattgggaagacgctggcctccctgagcttaattgagtgccatgtttcttaataagagtgtgcactggcccccctgcggtgctgtcaaaacacacattcccaggcagtggggttcacctgcctatgcaggacccagatatgacacgggggatctgaggcacacccctgattgagaaccgctgccacgggggaaatgatcatcattgaaaaatggtaacaacaaaaccaaatagaacggattaactttgaaaaagtcagggatgacacaccttggcactctcagagaaacagaatattctttttttttctttttttttatactttaagttttagggtacatgtgcacaacgtgcaggtttgttacatatgtatacatgtgccatgttggtgtgctgcacccattaactcgtcatttacattaggtatatctcctaacgctatccctcccccatccccccaccccacaacaggccccggtgtgtgatgttccccttcctgtgtccatgtgttctcattgttcaatcccacctgtgagtgagaacatgcggtgtttggttttttgtccttgcgatagtttgctgagaatgatggagaaacagaatattctattaagctgagcacttgttccccatgactttggagaagtgggagtgcgcgttcatggaaggagtttggaatggattgttaaggcaggggacttggccacttactctattatcctgaaaactttaagctgtctgaccagctcctgtgtgtaagagactcaagaggagtcacctttaaactttaagatgttggagccaaagagctgtctttattattgttttctatgtcaagtttgaggctgtgtttaggggacagccagctctgtgactgggcagaggcaaggctattaagagaagggacagaagttgttcggacagtcccacaaagggcctcctgaacacaaaccaggtcagtcattgttaccaaaaaccgctcacagccactctcccgacattttcctctccttgtcaggcagtgcccctcagacatggaattctggctacaatcagagttctcagagatcctctggcctaatctgcccactttacagacaacacaactgagattgagctagaacaagtagcttgtccaagctcacaagtgatcagcatcccagacaaactggccctggcctctcgtcccatgtagaatgggcagagggttgctggggtgggagccccttgggcagggcagttgttaggctgctttttttttttttttttttttttgaacattttcattctctcagctgcccatgctgggactgtgattttttgtatcctgagttacactggaagcttcctgagaagcgtgtccacggccccctcacttcacatggcctagggcgaggacaagtgtgtggtttccaaggtaacacatagctgggtggattcagcctcccgggccgcctcctcttcctgggaggcttcatcttaagcccgcaggggaggaggcgtgggaggccaggcgacgcaccgccttcccattcacaaacacggactcttcccgaaaccagtctcccctctgtcctcctgccagggttcaagggcagatgacccctccccaccccgtcctgaactcctggagctaaggaagctcctggaggacttggcaagaggcgtttgcctggaagtcaacagaaccccagctgacggggaggtcaagccttaacatgcccggagcagggcttttcacacctgttaatggacacagcaccacccagtgagagcatgatccaggatgacattccccagagacaaaacagaaagtcaatacaggcagccgagaaacaagccttgctgccaccacgagcacacccaccccatcggagacgccagccagggccagggagagcagccgggggccctcacacctgagggacagggagcaggggcaggaaagccccctctgaggcagaaagggttaagcccaagtgtttaaatgtttagcaaataaaaccaaaatgtcacacagagactgccagggctggtgtagtaaccatggcaatccatggccagcggccgatccaagtgaaaaggtgctgggatcgaggtgggcctcccagagagtggcagggagggccatggtgggcatggccagctcactgggcaacctgctgggacccgcagccccttaggatgcagaaagcacgggccagatgccaggtctgtgggcttcaggtcaggctctcagcctgttagaggctctactttctccttagaatgaggagggagtaaatctgccatgcctaccccagttttgtcattcattcattcatttattcagcctacactcattgaatagcacctactatgtgctaggcactctcatgcctttgggggtccaacagtgaaaccaatacagtccccactgccatggagcccacagtcagagaagggagttgcaggcaagaaatagtattcacaaccaacataagacacgcagggacaagtaagagccgctgctataagagctggtgctaggtccactcctagaaggggcaccctggggtcagggaagggggacgatggccagagagagttcctggaggaggaaatatctatgctgaaacctaaaaggcaaaaaggtgaaggcggccaggcccaaggcctcatagatgtgaaaaccctctaaaaaatacaaagcgctagacaagatgtggccacaccatcgtctctgaggcgcttgctaatgtatcagctctgagctttctgtcttcaaagtgtagtctgacgaggatttattccatggtgttctgacttctcgggcccagttggtggtgtagctcctctctctatttctccctttctttctagccccactgtgcacagctgggccaggcaggaggccgaggcccaaagaagagcagcgctccagtgaatccccatcaccagtcgctgttctctggaacacattccccattttcaatttcccttgtgtgctgtgatcatccaggggcacactcatgaaagtgggacaggagagggatgtaaacctggcagaggaggcccccatctggaatttccttgtcaaggtctcctccccttcagtacgagtggcccgagctccctccttccatctgctcatcacacctgagttaaggagctgacatgctcaaacctagccaggctgagaagtctgtctgggggtctcaagatctcggaggttcaatgaaggtatttctaattcatcaaccaaccagccagagacacccttaggaaacctctaccaggtgtctgaagaaggatggggactctagcccctacctggggggtttgggcagcctccacctcccttcggaggacaggcacagcttccttctctttttttttcctctcctgaaacgctctgggccagctttgtcctgagcatacaaggtctctgctcctggcgaatgcagggcacagcatcatctccgcgtgaaacctgcccagcctctctgggagaaatgcatcactccctcctccgtggccacttggtgtttcacagaccctcatattatggcacttatgaccctgggtcacagtggataaaggtctaggacaaaccaatttccaaaggcaggaatcaggtctgctttatttctggattctcaatgcctagcacaaagtagtcctacaataaatgtttgttgaataagtaaacgaatgaatggactcaccatttttatagactgtactagggttggaaaatttagagaggtcagtacgtgctctgctattataccttgtctctcagtgccaggacaccttacaggttacattcaggatgtgacttgagcctgctttcttttacagggagaagggagggtgagggcacagagcaagacgcaacgtgagttgtcctgtctgttctttcaggggaagacaccactaactcatttagcggtgggaccccaaagcacctgggccagcaacacctcctgcattacagacacccatgtccctgtgacagcacattacacgcacccaggaggacactcccatccacagagcaattatgccacaggaagtgaggcttcctataatttatgtcctgtaatttcaagtaatttccctgtctgctcagaactctattggtatttaatgaaaatatccacttttatatacctaataaattaaaagcctcccctttttttggtcccttgtatttcaaattcatgaggttgaaggcccatagtttgttactaccgttacgtttctgttgagtttgaaaaagactggaaacatctgagaccaacgctagatcttgaggggattgatatccccaggcaagagtggatctccaccccattgatctgattgatgccttttactttgaatatggccaagaaccacaatttgaaattaatgatctctgaagctcccattctgggactggattatatgaactctgccactgctctgtatcccatcctgggtcacagtagtctcttcagtttaattcaataaacattcactgactacctgctacgtgcccggcattggcctggatgtagggacggcacctcccatccctgcaactttattaaggatgccaggctctgctccacgcctccggatgtgaatgtgtctgcaccccaccccttattccatgcctggggctctgagccaggcacttcctcccaggggtactggatccctcccatcctcccttcctcactcctgccccagctctgggcatcaacacccctcacctggcccatgatgacgtgcttcccactgtcctcctgcctctgaaattggcctttcctatatttgcatgctgcagatgaagagtgctgtctaaaatgtaaatctgatcatctctgtccccagcttgaaaccttctcatagtttctgctgctgcctacaggacattccaaaacccttcagcaaggcaaacaagtccctacgggtccttcccaccctccatagtgaacttgcccctctacccaggaccctgtccttgagacattcccagtgtgctctgcagttccccatctcagagcctttgtttactctgagacctctgtctggggtatcctttccactctgtcagccagacaaacacattcttacttaagctaaggagttctgcatatattatctaatttaatctgtacaataaccctttctggtaggtactggttccgggtgggtaggcatattcaaacctacccccaaaggctgaggaagctgaaaggctgaagaaaggggctgacatatccagtttctcagaaagaagcatttaatagggacttatgaacaaaagccacagtctctggcagcagtaagacaagatggtggatcctgcaccacgaccccctagtcccagggattaaataccagaggaaaggggtatatgtgcttcagaagcaatttgcctaagggcaggacttacagtaaacagtagataaaggagaaatcttagaggctttcccgaaactgggttaatcggaagtcaatatggaggatcagcatccaagatggagttgctgtggcctccacagtatggttattagtcctattttacagaaaggaaatagactaagaaggattaagtaacttgctaaaggccacctacacactaaatgtgacaaacagcatgatttgcgccaagctgggctgctctgaagtctacattctcagtagagaacgttcctcaagcctgggtcataactgagttttatgattctgcctgctagcctgccttccaggatggcaccagggccattcattagagccatagattcactcaaggctgatgacccctgggagaagcaatggtgaattctgagtttctcatctagagaactgggctcctgtcctgggctctgcacctagaagaacattattaaatagatgctgaaccaatgactgcacttggtgggtcatcaagggcaaaggaggagaggatactggggagcaagaggagttcagtgttttgtgtgtggagccaggggctgccggtggcatgtaaaacgtgagcctgcagcctggggaggggattagcacggtctgagagctgttggtgagagctaaaccacagaagtaaatggactctccaagggagagcatggttttcagtcagagttttggtaaataaacaaaatgcattgcttcttgtgttttcatttctctcccggacacactggcctgaggaaaagaggtgcctgagtctttgaaaggtccgtgctccaaaacgccaacagagagggagactgaggagagatggggtggggtgccatcttccaacaatggaggctaccatgcgggaaaccaaccccttcttttccctgctccagaagcagaaccaggccagggggcaagttccagggaggctgcctcttctcggcagaagggcgggctttctaaagacattggtagggcagcctctcccaggggggccagcagctccgtcacagtagcacacacagaggccctggggttcctgcactaggtggacactacagtttaaacgtgtcccctccaaaattcagatgttgccaatgtggtagtgccaagagatggggcctttcagagatgttgaggccatgagggctcctcccttgtgaatgggattgaggcctgtatcaaagaggccccatgcagtgttcagtccctcagcctcctgccttccctgcctgaggatgcagcaacgtagcgccgtcttggaagcagagagcagccctcaccagacaactgaagctgctggcaccctaatcttggacttcccgatctccagaactgtgagaaatacatttatgttccttataaattacccagcttgggtgagagttacccaacagtgttttagaattcttcttcctgaaaaactcaagccatctaaatgaacaagtaagaatactgttctaaaaggtactcccccagcctcacatgtgtgctgggcagggcctgggtcctgggtgtgagcttctggggcaaggctggggaagacggggacatgatcatctggtccctgctaaaatttagctaggtgatcaggaaccactgtggatgaggaaagctgtgagcagattcctagcaaaggtcctgacatcacccaaaggggagatgcggcagccaccccctgccctgcctgcttcgcaacaggtgagcagcagctggcctttgcctgtggaagggtgcttgctaagcactcccctctgcataacttcatcagtcacacttgggataactccttcctccactcgcaggaagcaggttccgcagctggctgagcagccagatctaaatcagagaattacaagattggggggctaagtaatagatgaggaaactgaggcccgagaccaaaaagctaagtcaaggtacgaccagctttggaaaagagttaccttgaactcagcatgctttccattcaaagaacgtgctacaaacgtgctatactctgccgagaagagtatactgtcagacactataagtctctggacatgcaaagattaatgcaaagataactgtccctgaggtagggaagaaagacacccaacagaaaactacaatatggcccagtgcggtatatacaagggcgctccgtaggaacctccctcccactgactctctgggcccaaactgttcccatttccctctggcaagagaaggtctagctgggcacagaaagaactttactggaaaggtaagaggcacagaggaagccggttttggtgactttcctcaagtgacggaggctgcagggaggataaggggctgggtggtgggagctcagggtacaggcagggctgggccagagcaggaggaagcccagccacctgccagtaccaggcagtcgtgatagtgaccacctggtggacccagctggtaagtgcaaggcccagctagaagcagtgggacaaaggtcacaggaaagggaccaaagtttccattctgtgaaagcccactctgtactctacactgtttccaacccctgcaagagttcagcaaagtgggtgatgtggttcccatacttcagatggggaaactgagccccagagtcaggattcaacacaactgatttcactttgtttctccaaattgtgtcaggccaaaatgaatgacccccaatagcatcatctactgcccatgattagggctgaaacagagattggccatgagctggacatgggacaatgggtacccagccaggttctgggctgtcagcaacatgaccctgccaccaggccggaactgagtcaagctgcagctggaccagaacaggctgagagctagggctgcaggccctggactgggaacaaggacctcaggagcatcagagggagggacacctggctctacccaccccaatgcctggagcagaaagaggaagtaatcaggcctagcaccaccaaagtgtggggttgaggctgagaacagctcctcttcttccccttcctcaagcctgggtcataactgagttttatggttctgccttttttctttgttgtgtgtgacacctccccacacaggtcagggtgacacatagtaatacagtctccctacagatgagaacatgaacactgagggactgcctggatcccgcggctggctttgggtggggtggaaccaggcccggagcccagactgtcaacttctgtcctgtctcgattccgtggccctagtcctccctgcctgtactcctggctcctttctggggctgactggacaatggtctgagttaaagtccaccactctgtccaattcagactccatgaaggaagctgcctggtggcatctggcacaggcacagcccctgtccaagcatctgcaaccctttagaggctgaagagtcccagcatccaggtcagtatcctctagtcattgacagaatgcagccctgccaaggtggcctggagccaaggcttccatgtcccagccagccacagtggcccctgaccttcagacaaaaagccaaggctctctaagaggaggaggcactcccacctgcgtccgcactgctgctccaccctgaaaatgccgagtaacaaatgggactggatttgaacggtgttgttaaatagcgcttcacaaagcactctcccatgcgctcctcatcccatcctcacaacagctcagcagagctggaataaaggccccatgttctagatgagaagatcgagacccaggaaggtcacagggctggccaaagacacaccaagaaaaaaggtcatggccgagacttgaccccagtttttctgactctgagctctggtcttcgtcaatctctcgcctgctgcccagatgtgaatctatctgtgctcctccagccaaaggaccgggatggtttccagattcacatgcacatgaggaaaaacatctggatagtttagaacttctcaggtccacagcagtgcaggtcagcctgaagggccgggggctgggggaagctcattgtcaccagaagatgcttcagatctgttctctcctgtctgaccctcctggcccgggttgaaccatcctccctatgtcagccaaactggaagtgcaccctggaggcccagccaatgtttctctgggtaccaagtcactcctgggcagcaagaaacagaggccttctcggccacagcagactcttactctgtctagaaaatgacacccccagcctagacccacaagggtgaagaccacaccattcacaaaaagcagactccttggtggagtttggtgcagcatatgtgggggtacacaaggcaggtctgcctcactgaagggatgaactgagtggcccaagttcagaaaggacaagagacacaaaaggcagagcaatgcatcaggggctctcccggtccgatggtgctcagtgagggtcccgaatacggcagcctcgctcaacatgaagccctatgtttgcctctgggatccccactttgaagacaacttaacagttattcgaaagccacagggcggcctcgcagtttcctctcccatttgggtccaaaccagaagagaagagccacgatcttgggcaccgtcttgtaaaatcacccaagtagctgctaagggagtgggttttgggggtggggatgggctcggctcagagcaaggccaaaggatcagccgctgcatgaaggggtgaggtgggggcacctacctggacttcacgtgtgtggtaggcgatgatcaagcccaaaaggatgatggtggacagactgataaggcatttcagggccaacgaaaacatggagtcctgcaggaacaatggagagagagaattagggagtgcggggaaaggagcgtctcactttattctgcggctgtgtaaaagagaaggggtggggacacaggagggactgttaccagcccctcctaggagcaggtgtagcacaaagtcagcctgagccccacaaaagccttgggctgtgcccgggccggctctgtctcagcagctgccccctttgagcctctgttttctcgggctaagtcgtatttgcattcctgggatgaacgctacttgggcatgatgtattatgtttgttatacacggctagattcagtttgctgatgtgttatttagaatttgtgcttccatgctcataactcatatgaacgtcattctttgttgtgccgctattacatggtttgggcatcaatattacgccagcttgggcctctgttttctcttaaacccaaaccagaggatttcggaggcagaattctttcaggaatgaatttgaatgtcccggcagctgctctcatctcctggcttaggccaagggcaggggagggaggcagggacggcagaggagctactggagagagaagccaggaagcacaggagcagagaggggtcctggcaggagaagtaccctgatggtccctcctgctagggattaggtgggggaggtgagccccgtggcctccactgcagcctttcagtcccagggcagcttagagaaaccgagaagtgtggttaagggcatgacctccggggccagactgctgggtcccagccctgcgacagccatttagggctacctgaccttggaacgcccactccacctctctgcaccagcatgcctcctgtgtcagatggagataatattctggactacctcacagggctgttgtgaaaataaaggagttaatgtatgcaaagtgcccagaacagtgcctggccaagtaagtgttaactacccttatcatttactttgcatcctctacaaatcagggtgtctgggttggaacttggtgcacctctgggcatttcgaagctggaagtagagatagctcctagttccaaaggaaggcgggaacacagccctgagcaaaggcagcagatgagatccaggaagcatttccaagcagtgactgtgtgtatggcggccctgcacttggtcctgagtggtgcacgccacaaaagaaacattcccttcctcagggagctggtcattagaagaatgatgcctgatttctggaaggcaccttacagtttacaaggtggtttcacgtatttgttctcatccatcctcacaacagccctcggccttttaccttatagatattacaggctgaggcccagaggagggtgggtggcttgtgccagaattcaaagtcaaggcctctgactcgcagtacagagcactgcccacaagccctcaggcacactctccaatgggaaacaacttagaaacatgggaagcatccatttaaatagacctaaatgacatcttaagacaacaaggtaaggtagagtatgatcaattgccagagtgaaacctacagtagagctaggggagctcaaaggagggaggccactgtggatgggtcagagacagctttcagaggcagatgtgaggagcagctgagatctgtggggtgaggcggtatgtccaatatggcaaccacaagaatgagaggagggcttgggactcgaacccaggacttccaagtgcccaggtccatgctctcggccccactctgtgtgctgagatggaatgaaagtgctctccctgatgtctattaatctccccattcatttaattggtacagttcttgaggcccactggagatacaaagaaaactaataaagtaactaattcattcactctttcacaaaaatttcaaccacttctcatttgctgagcacttgctagatatccaacagtgtgctagattctatatatacagtgatatacaccagaagcttctgatctggcttattcactaactctgactttctacattgcatggggtcgtccaactatgggaaaaggtctccattatttgctatgcataagatgatctacacataagccagtcttcttttagcctcttcatgttccacagttccataagagcagcctgcaatcatttactcagcacacatgtatgggggcctaaggagggctggtgctgttctggtccaacataagcacagagaaggacagaacacagtgctggccctcaaaaatattttgatcttcacaagcacttcctggtgcctgaaatgctacccaaccacaagacccagatggggctgaaaagagcaaatggtgaattcaggaacactcagactgtattagggtaaaacaaacctccctacatcaatcaactggggatcaactggggacagctcacaatgttttccatccagaaatgaccataactttcttttcaaaggggtctgaaagcatctgggagcatcacacctccccgggaaggatttgggatcagctgcacatttcagccccttatttatttcttttggcagcaatgaattgacatcagaatccaagtctatttccatcattttaaaggaagcagtgaagggaaaggggccagatgctctctcctttgggcctcttccttttgtcctaaagctcaaaacctttacatgaacaggcaactcccacctgcttcttggttttggccagtacaacctccctggccagctccagccctgtgggatgaccaagctgtgtgctggatcaacagggactctcgatatcttacagatttctttgcattctccatcgcatgtcaataaaaaaaattaaccaaccgcttttaatagctggaaaacatgtcaaagaagtctggctgaactaggaatgttttctatttggtaaaatgttgaattagcatcttctctttgctgcctgaacatcagtgaagcttgaaattgatatggttccttgggggatggcagtgacaccgggctgccatacatcccaggatagggtacctgccacacgcattgcccccactcactcctatctgaggaccaataaggggcttgtagaacagagggaatccagcggtcaactggtcaacccttctgccccgtgactcagaacttttcaacacagagtaacaatccttaacacacaggaatgcttaggaattatatcccatttgatgagaatcatttttttttttttttttttgagacagagtcttgctctgtctcccagactggagtgcagtggcacgatctcagctcactgcaagctctgcctgccgggttcatgccattctcctgcctcagtctccccagcagctgggactacaggcgcccgccactacacccggctaatttttttgtatttttagtagagatggggtttcaccgtgttagccaggatggtctcgatctcctggcctcaagtgatccacccgcctcggcctcccaaagtgctgggattacaggcgtgagccaccgcgcccagctgagagtcatgttttaaagtcatttattcctaaatgcccacaaattttcaagtggttaagtagatttgagatcaggcagtgatggaacactacgcagccactaaaaacacttctgcacacggccgtaatcccagcactttgggaggccgaggtgggcagatcacgaggtcaggagatcgagaccatcctggctaacacagtgaaacctcatctctactaaaaacacaaaaaattagcgggacgtggtggcaggcgcctgtagtcccagctactcgggagactgaggcaggagaacggcatgaacccgggaggcggagcttgcagtgagccgagacagtgccactgcactccagcctgggtgaagagcgagactccatcttaaaaaaaaacaaaaacaaaaacaaaaacaaaaacaaaaacaaaaaaaaccaaaaaacacttctgcagacaatatctgaagacatggagaatggttgatgatagactattaagtgataaactcagaccccaaaacgatatgtagtatatttccaattatttcatttttaagcttttttagtgtagaaaaagactgaaaatatgtcaatagaattcctaagagctgcctccatccatgtggtccctgttctgctccaggccacgagccagcccttcacagatctgtgatttctcattgatgacaataatctgtaataaagcacatctataggggcctaccatgcaaggatggcattgtcaacccactcttacagaggagaaagcttaagctctcagaagttaggtaacttgtccaagggcatgttacctaacttctcaccatggcaaagccaggatttgcaaaagccaggttttacacccagatctgtctgcctccaggttccattgccccgcctgtgtcccagcaccccacctgctctggcggccacgccttgctggccctccaatatctgcagcgaggcttcttagagctgttccagcctttcctcccctgaggctgtgcagagggtgatggagtgtgttccccagcttctgagccagccacataaattgctctcctggcctgccttgtagcttccaaaaacaggccagaactgtaatgattatggtatatcttcccagagactttgaagttctaaatgtattttattgtttgggtcatcgcaaaaaggagaaagctatgcttacagacagagacctggaggggcactgaaccaaactgaaatattagcttaactgagataatgatgcgcaggctccttccccaaccaagctgttacccacaaagagtatatgtgtatggttgtgtgtgtgtgtgtttatacacatatgtggtccattcacgatttctgtcactggctgaaacccccaaagggaaaaggtgatagtatctgaagttcataatttctgaattaaggtctgatgtgcctgcctgacatcactatgttttgtgcattcaatctgggaaataattgatttagaaatcttttctatctaataaggtcaacttttccttcaatttcatggagaggctccaaaattgattgatattcaacatcggcttatgactgtggttctgtaatggttgtcctaattagatactcttgctaattaatgctatgcaaattaaaccagcccctcttccgctaaagggaagaccgcatcactggtcgctgttctccatggagacctgaggcttctttccctccacatcagcaccaagccctggccttcctcattcctcaatctcacactgtccagttcttgggatctttcattcttacccatcatcctcagctcctatcttagcacagcctcctcctcccaggtgcagcaccctaatttaattgcaagcccaggcgtggtggctcacgcctgtaagtccaacactttgggaggccaaggcaggtggatcacttgaggtcgggagctcaagaccggcctggccatcatggtgaaaccccatctctactaaaaatacaaaaattagctgggcatggtggtgcaagcctgtagtctcagcttctcaggaggctgaggcaggagaatggcttgaacccaggaggcagaagttgcagtgaaccgagatcacaccactgcactccagcctgggagacagagcaagactctgtctcaataataataataataataacaacaacaataataataataattgcagctgttggccctcccagcatcctcagagcggcttcccaacctggctcctaccagaagtcagctaacagaatcctgtttcagtcactaatgaatgaagtgacagaatgaagtcactcagaccctctctctcccaggactgtccaacctgagaccgggagagacagccgatgctgtcacagtgggaagggagactctggggactccagagggcagctggacctctgaccagcctgagaagggagaagggcctgatacttgctagccaagacagctctggaacagaggcccagggtgtgcatccgagggcgcaggagtctcagcctcctccatagtgaatgcctggcctggacaagttgcttccttctcctaagcctcagcccccagtaaaatgagactcctggacagaaccttctccgaagttcagttaagcctgatgaccaaggcgccgagcacacatgccatgacaaacaggtcatagggacatgtccaacactcattcctttttttttttttcttaggagttttcttttcccaggcatttctgtgatgaaatgttgggtgtgaaacggtcagccacaaaacccactcacaccatcttctcctcaaacacaacaaggcaagcttcctatttttagtcatgggggggctaacgaagatgttccttgtctctttctaaataacataggatttgaaaccaaaaggccagagttcaagtcatgtctttgctactaactagctgtgtgacactggatcggtcctttaacctctctgggcctctggtttcttctctgcaaacaagaactacccttacttttctcacagctgttaggggatgagatgagatcatgcatacgaaaaatctcattctgttttcacacaaagagaagcatgcattcccttgtagtcaaacaccccttctcttgccatacagatgtcagtgcaggtaaatgcagctgatcctcagtccggagctgctcactgcacccccaatatcagcattttatggctgcaataatttataaagatatccctgaggcatttcagaaagacacctttgcaatccgcatagccaaacattcattcacttgtgcattcatacaacatatattcactgagcacttaccatgcccaggcactgtgctgggcaattgccaaatgccagggattccccacccgctccaaccccaacctgctgagcctgaatcccatccaggagctcccaggagctcatcccaagggctgccctctgcaccatcatcgccccgtcaccttgacatcccatcctgtccctcttggacactctccctggcctctctgtcctgcccacagtgcaaggtcaagaagagatgggccaagggtcaggtcagggggccctggaggacacatcaggctgggacagccaggaatgggcaggaagcccaggctgagggagaaaacccacaagtggttcctttgcgctcgagtgaccagctctctccacggcagagctcaagaatggatattagaggccaagctccaggaacctttcctgcctgcctgagcccactgtgtgggtgaggacatctttaccacaggtcccaggggctggagatggggctaaacctcactgccaccttttctccagcccagtcaccttcttacatgaagcttctgttctgggcccacccctcaaccccacagccaggggatgcttgaggtggatccccagtgggcggaaagctgagacaagaccatccacactctcctctcagtcccaggagccagccaggcatcatgagccagctgacccgcatcaggatgcggggtctgacctagacccgagagcaggtggctcctcagagccctgtcttcagtcctcctgtgccctcctcagcccccatccctgaacggggtccatatacccaccatcgaagctgggagccattacctgctttaatagtacacagggtaacctcagcaccaggaaccccgctggtctgccctgggccccacacccttcccgaggctggccatgcctggtgtctcccattggcactgcccagctggggtgaccagagcacctttcaccatctgaccccattttcccactgatgttgttctcacacccccaccagagtgtcaaccccagagggcagggaatttttacattgcatttgttcactcctagagccccatgcctagaacactggtctggcacatagtaagtcaataaatattagttgaacgttgaatatttgaaggaagggagcaaaatttttgagatatgtcaagcaggtagacacttccatcctgaatttccaaattcatcaaaactaaagagaggtgatgaaagtaacagctaacatttattattcacttaccagaggccaggtactgtgctaatttcgttaggtcctcagaacaacccatggccccattctagagatgagggatctgaagcctggagagggtcacattcccaccgtccctggatgaggaagaggtgggggctagattcaaacctgtgctctcaccactgatccagagggaacctcaggaagacaggatggcaattgccagaacatcacccttgcaggccctgcccttaccggtcccacctgctctctgaagaagcccccagttgtgtggctttagtggtgtgatagatggtgaacagactgagctcagggcttggggtcttcaccgtctctgcagactgggcccggcacggggaaactaggcagataatacttgtggcgtgaaggaagccagtggtctcgacacaaaactcataaagtcaagttgccctggagcatttccctggatctctacgttgccactcccagaaggagacggaacctgatgtctgagggacatcatgcagttaataacaagggcattcaggtctgagcagagggtggcctactaatttttagtgaagccagcatgatgaccaggacaccaattaagagaaaatgatcctccccaggccctggctctcccattgtgtgatgtcccaaggaaggcagaaaaaggtcatttaggagaccacgctcccaaaatatcaagtcagacggggcaccccttcaggccacaaacataattccaattaaggagatggtttcctttataaggtctgggcagaggggaactggcatatcatgaattctctactgcatgcttgcttataatttattttcctgccccacttacaatattggcaaagattccatgcgattcaatcaaactttttattacatgtttgccatgtgccaggcactgtgcgggaggtggaaacatacaggatgaggcctttttaaaggcagtttggtccttgctgctcctaaggtagccaaaagctggcccacctaggattcttgcagacacaaagcaagcacttaacaagtgtttcttgggtaaatgaatatggaacggtaaatacagacttaaacctttgggctccatacaaaggcagaatgggagcagaagggtttgtaactccccacccctacagggaggatggaggtgggatggaagcccatcaagcaccaatagcccgggtccttgtagaactgaggggcttggcaccaccccagagcaattaaattggaatctctgcaagtgaggtctctgcactaacttttaaaaaaagatctcagtgaatctaatgtgcgggccagaaatgagaattgctgttctggggcacaaagaaagaagccaggaggctggggttgccctcacagctctgagacactgtgaaacagacagtcatacacacaagcaatggagcttagaagccatctagttcagtgccccatgagtctcctaagatttctggcacatggccatccagtctctgcttgattttctccaggggttggaaactcacttcctctcaatgtagccctggagagactctattttggatggctctttttcaaagatctgcctgcagtgcttggtcccagtgaaacaaatgcctctgtgaagacctgctctgactttagcatcccggtgtctatgtcaatgactttgacaagtgagcctctccctgggacacacactcattaacgtacagaacaccaggagatcagctagttccccaaccctcattctccacgatgacactgaggctgccttgcccccatcatacagcatcctggcttggagaaaactttagaacccaggtgttggggctcccggcctatgcttacaggggcaggcagcccggcccaccctgcttttcatactaacggaaatataacaaccggtccctgaattcatctgttctccaaaagcctgtatccctatcctggaagtcacctccaagactgtcacttagtcactgtttccttctccaataaaaaaatgggctcctgatgagcttttagcctcctctgcttgtggaatgtgagtgctcttggccagttagcaattacattactcttgtggtgtcaagaagtccctacagcctcctctggctttgatgaatgcgtacctgccactatgcatcaggttctgaaggtcctgacaccatacctttatctcaggagaactgtatagcatactgaaggttcctagtcccagcccccagatctgtcctggcatccagggtgtacagagttacagtgaaacacttaacctttattcaccctcctagcgcctcccagaacgctggtcaatttgccatcaccatgaggggttcacctagcaaatatttactgctccacctgccaaggatctggcccccatatttcatccagattgcaggaacccccattttcttaaatgttctagaatatttgaaacaaataattgtgctttctggatggcttgctttgaagtagttttgctttctcttagtaaaacctatctggctcccaaatgaataaaacagcaggaaatcactttgctctacagaaagctgtgggctccctgttagactgggttgctgactagaaccaaaccagcctagctgggcttgtcccaggcctgggcttccctttccccatcctgccccagccatcgctgacaagacgcacaacagattcccagattctctgcaggagctgtggtcagctaattacagggaactggctacattcatttcagatggctataacttgaaataatgttgattttcatcacctgatagccacagagaggtatgtgggttttaaagacacaaagcaaggcctacagacaactccccaccctgggtctctcagccttatcacccctccaattggccttccccctttcctccctccagcccttgcctctgtctgcaccagaagctgctgcaacactagggccccagctgaaccttccaacttcgtcagagaattccaaaatggagaaaaccactactacccacctgatgctcagaggcaaacccatttccatccccacactgggcaaaatcatcccccaaccccggcaatgtttgggccaaatgaaaatttttaagacacccagaaatcacatatggtgagaaaaacaaccgcctgcaggctccacagacatctctggaggctgttctggagtttcccagataaagaacagcctcgtccgtgtttcccagccatgcttccaggcttcccggagttgccagcattctgagggcagcatcaccttccttccatttccacacccacggccttgccaacaaacgtgagacagtgagtcctccacccaacactcgacttagctggaagaggccttctaagccatcaagtctgactccccgattctataggcaagcaaattaaggcccagagagggactctggcctacccaaggccacacaccagtaacagaaagggctgataatgccctaagccttccaagggtggggctggtgttctgccacatcctcactctgcccatccaccagcttgaacactgtctgaaagggacaggcccctgtcttagtcctctctccacccctctgcagctactcaattcaggtttggggagtgaacatttcctccatgcctcattcaaggacaaatcaggagaaacaataattacctactccaggttctctatcttcttttggcttaacaatacaaaagcttaaacataaataaagggaaatggtctggaaaaataaaaaccagttggcatggaactattggcatctcagtgcggcataagaagtagaaatgctgtttttcagaaacagcacagccgtgagtttcctaacatttggcacaggtttttcaattgtttggatgtgatggacgatgttgatagaagtggtggagaccaaacacaggctattaatagaccaaacatggcacttgtataattctttctctctctcactagctctctggcaccagactgctgccaacctgcctaccttttactttgaggtgccatgaattccagcaatggggcacgacacgagccccactgcctgcccatgtccaagcatgttcatctgagagcctggaggaaggctggaagccacacaccaacgtgggccaccagcctgtacagggcttcaaggaaactgcaagatgcaaagactccttgggtgctggtcctgcctatcacggggcatgcagtagagtctcccaagtagactatccatggtctagggggggtcagggaacctcccaattcctccatgtggttatttcctccatttctttctccaagaacatgaggcagccccatctcaaggcgggagctcattccacactaattgattcaagttagagccatttcaaggcagaaggatctccatggttcccctacaggtgttgcctctaggaactctccacagattcaaactctacaaggacttactgagtacctgttatatgacaggctctgagtctacccatccatcttcatataaactctcacttaatcctcacaggaaggaactgtccccacttgacaaatgagaaactgaggcacggaatgattatacaatttgccaagatcacacagctgaactgtgggagccagacttgaaacacacagcttctgattccaagcccaggattggtaaggaccgcagcacagtcccggctgagacctacaccctgagctcttcacggaggaggtcgcttgttcctgctccactgaagccagatttgctacttctttccccctgagctgcacttgtttccacatccccagaactcccggtcctgaccagctgtcctctacctgcatggggtcagccaccgaggaagccaggccaaagactagagctggaccgtttgacaccatcaccatctttaacatctattcaatgagactaaaaaatcctttcttccttccagggttgttgtgaggaagagcagataatgaacgtgaaaatactctcccagtcgagggttcccacgggcttaaaacagcctatgcagagggtggcgatacattcgggtttacccaggagagtccagtgtatgcctgttatctggcataattattactatgaatggtaatcattaatataataatctcaaaagtgtcccagtttagacaatgaatcatatgatcaccctatatatgtagtatttgctgccaaagggtctgagagaattggggcccccttcccgccctctgcccccacacctgccagcttccacacccactatgtgcactccattagcagacactttgccaggctcatgggcagacatcattctgctggatcaaagcaattgttagtagacagtatttttagcaaggtggtgtcacagtgcctggattaattgcaattaattatatgtcactcctttaaggtttatttcatcaattatggacaatcacggccatgtgccttgcttgctttaacccttggtgacttgaatttcttggcacagaggaggctgtaaccatggaaaaggctgaatatcagaatatatttgctactgagtcactgtgtcctggatgtcagtttagggctttcctgtttacaaagcattttcttgcacagtttcctatttgatgctgggaggtagagaggaccactcctaacccacagatggaaaaactaaggctgggaggatttaagcaattacccaaagccatacagttaggaaaccccactcttctaacacagggttgccaaaacatttccaagtcttctgtatagactgatgagtgtgaccctctggcatcagtggtcagatagccccatggccaggcatggggacaggatctgagggcgtctggaggcagacttgccagggaggagccaaaggcacctgacgcatgtctgccaggcagagcagcccttaccttgagcatttcaagtggccctaatgtcaagaaactccaagaagaatgtgtccgtgccagaaaaatatgcaaacaaggacacccagcaccttccttctttgagtgttgagcagccggaagagcagccagaaggtacctcgtacaagtgaggagatggtaggactcccacagtacccctgggtccctcttgctgttgtaataggaggagccagaggaacaccccacctgatactcgactggccttaatttgggctcctgccccccgtctattttgccctgcaccggttacagaatattagttctaaacagatctctgagctcccctagtccaaagcctcgttttacagatggagagactgagaccccaagcagggaatgccccatctccgaccccacttgccagggcagagctgagcagggacgtgggcctcccctcctgtgggttcttgctgactgtggctgggagtctcagctgggaactggggtgctgtctggagcgtttctctcacgggaaagtttgctgcgtcttttcttccatccctctttcttacctccacccttgtctcactctcctcacccacatttcatccctctcgcactattcctgttttccgggaccaggctttaagattgtcagctaaaggggctaggtctgaaggaaactcggctggagcccgagagccgccgcccctgggctccctctgagtggcccctccaggctcagggctgcttcatggcacagtcggggtcctttctgtctctctgctccatcacctcacagaggacttggcacacagtaggcactcaataaatacttgatgaatgaatgaagggatgctaccctatggcctgttcccaagaagaggagaatcgtgcaaaatcacttccctgcaggccccatcatctaggtggggaacaacacttccaattgtggggagaactccatcaacttttgtttcctcgttccactgactaaacagatacttatttgcttagaacccattgtttaagcctttttttttttttgagacagagtcttgctctgttgctgggctggagtgcagtggcacaatctcagctcactgcaatctctgcctcccagattcaagcaattcccctgcctcagcctcctgaatagctgggattacaggcgcacgccaccaccatgcccggctagttttttgtttgtttgtttgtttttcattttttgtgtttttcttttttttgcattttagtagaaacagagtttgaccatgttggccaggatggtctcgatctcctgagctcgtaatccacccgcctcggcctcccaatgtgctgggattacaggcatgagccaccgcgcccagcctatctacatgtaacagctgtgatcaaagacctaggaaaacagccaacccagccaactcctcctcctggttcctcaccctggaggagctctgggcccgagagcacagaagctaggaaggcagcagaacgagtgatgcttatgggggaaaacctggctttccacccacagctgtttcaaggcgtcctgcagaagtgggtctgggggtccctgggcaggaagagccagtctggggctcccaggcatccactgccggtgatgacacactgagctatcaaagcttgggtcagagcaaaggaaaaagctcacaccagccaaatgcacagacatctcacagatgtcacgggctaccaggtggcaaccccgaagcagctgcctcttgtcacgtgggggccaggtgggtggggattttggcccaagggggtgaactgtctcactgaagagacacagctgggcccagccagggctgtgtgccgtggggagccaggtgtgctgaggtcagcggggaggaaggcgctctcgcagggctggaagaggagaagccaggcaggcctgaattacgagggcaggagtgcacatgcttcctggaggactcacccctctccctccagctgccaccagctgctgaccacggtgggacagccagctgacaggggtcaggcggccagaggtggatggacaagtacagaacagagagtgtgggggccaaacaggaaggcggccacgggtgtggagaacgtcagggctaagacagaccttagagtctttgcatcttacaggtcaggaccctgaggcctcgacttggccaaagtcacccagctgctagatccagatctagaatttagagctagagcctagctccttcccctactcccgggctccttctgctataccatgtagattccatagcaagtaatttaagacacaaatcgtgccatcccactccttaaatcccttctgcggctccccacagcctctgggatgaaggcagaccccctaagcaaggcatgatctgacccctgcctgcctctacagccccatatctcatactcacaccataaattctagccataccgagttgctcacactccttcaaaatgcactaagctttcgtttccctcaacctttccatgtgcttgctgggccgggaacaacctccctgccttagcctttcccgttcccagtcaaccttcaggaccggctccgttctcgccactcccaccaccctaccctccagagctgcctccgcctctgcgcttcctccaccctgtcccttcaggcctcttcgggagacaattctaagtgcgttgagcatctgcttaccaggctgtgagctctttgagtgtgggaaccaagtctttgtcatctttctgtttctcccccacccccagcaccttgcacagtgcctggaatgtgagaaaaactccattaatgtttgtggaattaattatcaaattaaggagtgaatgaagcctgggcagctttgacagtaccttgtttctcccgaagctactttacctacagaagggccagtgccactcaggacatctctaaccgctgatctgccttctgctctccctccctccccatgttggagggcagtcgggtcactccatgggaaaaacagcaactgagatacaggggacccaagtaacacccccagttgtggtgctgacacaggtcgctgtgtagcgatggcaaagcagctgagatggtgactgagttcacttatccatgaaatgagtgcataaccacgtgcccaccaccatcgagtgacctgcgatctgcagacctcaggaagcagggcgcagttgtgctccctccacccccatcactgctccaaggctctgcgtacctacaccagaaggggaacagatcccatagcccaaaggagcactgagcctccaggagaccctttggaggctctggtaatgtgattttagagaccatctgtcttccaaattctgttttccctgtacaaaatacaaacaagatacgacacctgatttacatcccctaagcaccaccagctgatagggaggaaaggtccccatgcagtgagacagcagcagggacgaacgtgacctgggtttggaaaagacactacaggcaatccacaaagtggataatccacacctggctgacgaaggtttggcccaggcacagagagtgctccacagtgagtgagggttgctggactcagacccccgctcagctctcactcgacaaggctgaggacctcgcctggggcagactcggccacagagcatctgagcctttctaaagcagtcctcagccacccccaagagcccttctgggggccctggccactggccactggtggaagtgttttgaatgatggagcgcagagacaaacacagacgggacaaggtgccaggagccacataccagagctgcttctcagagctgcaaatggctctcagatgacaccccagctgctagctccttgccaggggcagggtgggcagagaggcctgcagagcaggggctaggtcacagagctggggggaggggcacagggagtcagggatttctaagactcagactgggaacctagcaggaaaggcactggaaattgtacttactccatttggtttgtctatttgtctcttgcaatttatctagtatttcctaaaaggtcactgggtggtgatttcaataatgtaaaatttgtagagatgctctaaaagaaatgtacaaatttcacaggtttacactggcttaaaagcaatatattttattaaaagtgtctattctaagtgcactttggataggatttggagactgattggttagagattcaaaaggccttgtgctattaaaagatccactgtgtttttggggtggtaaaaagaaatagaaatcaaagcatttgcaaaggtatggttggtggatggagaaaaagcggcgtgtgagatcacaaaatcctttgtcacctcacagtccccgaagcagggagctgggaaagaaagatgcttattacaagcagagggccaggtttcctgcgaaggcttccgtgtcccaaaatctcacaagccgcttctcactttcctctcaccgctcctcattaactgaagccaatccttgtcattcaaaggaaaataaacagggagcaactgcctgcagagacaaagagtcctcatatcgggacaaaacggcttctccaagcagacaccttttccctcagccccagtcagaattctctatttctttccaaacagcagagccatttccttcctgtcagcccagtgatgcacaacttcctgtcaggacagctgaggaatctggagaaatgtgtcttccctcacagcctctgctcaggtttgcagggcctcagacagtaccagggagcagagtggagagctccaaagaagcagcccctcccacgcctctgcccccaccaacgccctccccggatcccccaggtcaggccaccgaatccagactgagtgtgtgcaccgcaccctgccatcttaggcttctgtctcccagaagcctttgtgggaaccagcatttccattcccaaagccaccaggtggagaccaggggcaggcctgcccctgcggggtcaggccccgacctaatcaggaccctggggcctgtcagaaagactgaggcctgccctagggctgcagagatggtgagggcgcaagggagggtcttttccgggtaaagatgggccgctgacagcccccttaggtcagcactctggcaaacccactgtggtataaaaataaaaacctcagtcccacagactccacattaaatggagtgagaggcagggagatgaacactgaaataatcacctccatttagtaagcgctctccacgtgtctgcattcttcctttaatccccaacaaaccctgggacagtggttcccaaactttgcggcacattagtatcacccagggagctttttaaaatccccacacccaggttgcacctcagggcagtgacatcaggtcagaagctgggagccaggcatcagcatttttttaaagatccccaggggattccaaaatgaagccaagttaggggaccactgagcaaggcactgttcgtacctgttttattaataaggagattgaaactcagagaggttaagtcgcttgcctaaagccacacagcttctaagcaatagaattaggcttctggttcatgcctgttattccatcacagagcccccctcactccaaactttctgcagaaagttgttcagctctatctaccaggtattgtctccctactacatccccatccccgaatgagagcacctgcagacatctttgcttgctagcaggagtaaggatgagatgtgcgagccgaaggggctgtgcagggctggggagagcgggctgagtgtgtgcagatggcctattgggaggtcatgggatcggcaggttctgctccttcctcatctgacaatgccatttaagttctctccagagcaaagccttggcctggcctaagaggatggccaggtgtgaaggaaacgcacgcgagagtgtagccacgtgggtgagcgagggcacgacagaggtggtgaggatggcacacagcctggagagggcgagcccagggtaaggggtgaggggagacccccgggagtgctccaaaccagaaccttgggggattgacccacttcttgctgcctgtgtgacttgcagcaaatcacttccagtcactgggcctcagatcccctctttgccctgcaatggggtgggaccctatggtccagagggttctcccaccctggcctccacagtgatcatggcggcccccttcttgggtgtgagcaggtgcgggtgtgggagcagctgtggcctcatcccaggcagggtccacacacagttcaggcacccacagagccctggctctcagagctgtctggccaagacagggaggccagtgcacctattgaacatacaggccgaggagaggggccctggggcagcaccccacacttgaccttcctgagtgtcccagccatgacctcctgagcttcacatcacctggtcgcaccccaaaagtggggcagaagggggctataagcaactgggatttaaagcccctacccctcaccccagcccactgacctgcagcctccactggctgcttccctaagtgccagacagaatctggtttccctcctgtggctcattcagggaccccccccccgccaccacctcctctgtgagctttccccggccctccctgacataattaaatgctcagtgctacttctgtgcctggttccaacctctccccttgcatatattacactacactgtgctcaccatctgtttacactgctgttaccatcagggcctcaagggaagagtccggtttgactcaacagaggcagcaaagcatcacggtctgcagaaggggctttggagtccgaagacctcacttagagccccactttgccacttcctcgccatgtgaccaagcctcaacttactcatctataaaatggggcagtaagagtagtgacctcataaagttgtcatacacattacatgagatgacacgtgtaaataagtggcttagcgaaggacctgacacttataataggagctcaataaatgacagctatgagtgccttcatatctctgacacctagggcctagcacaagcccagcccatagacatagatgctgaagaagtatgttgaaataagctgaaccccagcctgtttgtagccttgacggtctgcttggcctctccaggagctagatatggtccctgcccctcccacctcccaaccagggctggctccctgcatccatccaccctgcagaacagttcccctccccagaacaagaagctgccccatccaggttctagacaaaaaagccagctgcctggctctccacagctggttcccagcgtcccttcagcttgagagcccacatccccgggcttccaggcagcacccactgagctcaagcctcaagtatcctcagtcccagcctcagccctcatcaaatattttttttaatagagatggggtctggctatgttgtcctggcctcaagcaagtctcccacctcggcctcccaaagtgcagggattacaagtgtgagccactgcgcccggcccctcatcaaatctgaagtcccaaggttagcgagtatgcagggaggctgggagagaaaagcaagaggccccttacagcagaggctgaaaccttttaaagcaacagtgagaaacgctgagagagaaaccaggcggggtaggtggggagttctctcccggagactccttctcacccttgcttcccacagaacccaagaaaaaggcacttggcaatagttacaattccagacggcacttaacgaagtccaatgcctcagcaagacagacgtttggagaaataatgacccaggggactttcagggaaggctgtctggacatggaggggcggctgtgagatttaatgaagccagttctacacaagagtccagcacagggtgcggtgcccctgcctcggtgactgccccgaaagtaggagggggggctgcacagccaggccacaaagggcagacaccaggccagcaggggaaggccaaagaacacaccctcgggaccagcaggggcttgcagaaggggactccacccaagggagcaaatgaatgtcccccgttacacacagatctgggcagacgccctcaccctcactccttcccctccccaaccctcctccagcccctccattatgcaaatcaagtgactacacagatttgcataattcatgcattattagtacgcgttcttgtcaggcttttagactttataaagcaattttgctacctttaatggagagtaagagacaaggttctagagagagattttctgtccttctttcattagacatgaaaacagtctctaaatcttaagccagggagagagtcagacagaaatgaagtgacttagagttggaaacatgaccaaacacctcgttgacacttggtgtcaaaggcctgggtgccgggcatcgcgccggtcacacatcctgtcaggcctctcaggcactcagaccatggagtagtccccagtggggcagacgttattattgggaagtcactccaggttcctgggagactcagtaacaacaaaacccccactctgggtttgtatcgcttttttatattttacaaagggctttcgctctgctatcttactcagcgcccacaataaggctatcgggttggaagggccacatttttaccctcattttagacatgaggaaactagggggccagttgcagtggctcatgcctgtaatcccagcactttgggaggctgaggcgggtggatcacctgaggtcaggagttcaagaccagcctgaccaacatagtgaaaccccgcctctactaaaaacacaaaaattagctgggcatggtggcgggcacctgtagtctcagctacttgggaagctgaggtgggaagatggcttgagcccaggaggtggaggttgcagtgaactgaaattgtgccactgccctccagcctaggcaacacagccagaccccgtctcaaaaaacaaaaaaaagagagagaaaaaaaactggggccactcacctaagatcaaatctaggctctctgtattttttccactacaccagggatggcaaaccccttgccactcttccatttcccctgcccaagatagacctcatgaatcaatcagggcactcttcccattgagctcagacaacacctcagaatccttcccaacacagccctcctggaagctggtaccaattgtttcaacttgacacccagataaaacctatttgctgttcctgcactgtatcctgccaactcctcagcatccagccaacactgtgacagtgccaccagtttctgggaagtgcctgtgggctaagcttagcctggctgctcagccccaggagccccagacagccaccatcagccagctcaccggctccaaatggaaccagatgcacctgcatttgggagcagatcagggagagtgactcctacacccccgggcccaagaggtctctgcttttctcactgcgggggccccactacccaggaccactgaggccaccttgactaatgcacacctgcttcccacacagcaggagccaaaggtgtctgcttctgcaacggacgcagcattgctgtgtggcatggggccctgcaaggggttcagtcagggaaggggccacatgaccagaccacccccgcaaacacacacacacacttccctagggccgtgccccagccagtcccaagggcacacgtccttcccttgtacacatgcggagcctcctcctctagacagatccttctgcatgggccccttccacaaccctgcaaggaaacttgtttagtaaataatagtaataaaaccctaaaagtgctcattttgatcctcacgcacatgcttgttgtccaggctagagaaatgtgaatcctgccttccccaacgccctaccagcccccaagcccatagggcagccctggctcctttcctacccttgtcaagaggccagtcccctttggaagatggcaagcagcctgccggtccaaaacagtggggtggcacagcacccacaccagccaacaccagctggcagcggctgccctggctggggggctttccttctggaacccatcagcgctggcttcctgccaggcccaagggagatgaagtacaccctcttcctgaccacgtctaaagggcctagacgatgcctctcccagccagaacccacagcagttacctccactctcttgccttacccttacttcacagtgtggcaccctccccttcctggtctcctgagccccaaatccatgctgctattgcaatcatcaatgggcttattctccaaatcatcgctggcttcttctgccaggccttgctgagttccttcctgatatttacagcccccgaggctcctttctggaggacgattaggcagcagcatactgagggggagccaggagcgtctgccccccgggaggaggagtgttttatcactgaccttgtttagaagtgccggtacacagcaataacaaaaaccagactttttgttggctttatttatttttctatatcctctacagacagtgtacccctcattgtctgcaccgggagccgattgctcccctgccccttggtaccctactgccattgggtgtctgcagccagtttccatggggctgggtcagatttcagatgaacgagtgaaagaatacacaaaattgagcagagaaagcactggctccagaagctccacttctcgctgtactccacagttggggtaatcaaggcctttggggactgccctctagggatttactgtgcttactagaggaggaatgaaggtttattcagcactctcaggccctggtgctgtgtatccatctagacctatcactatgttgtgaggtaggcattagagcggcccccaaggccaacctcccatcaccaccacccacacatggatgtgaccaaagcaggcaccggactcggagtcttcctgctagtaagcggcagagccaggagttgagccggctccgcctgacccctcacccccctccctgagccctgggctcctcccaggcctgcctccctgaatcctgtctgccccctcccctgcctgccctcacttgtccgccaagcatctaccagggcccctgtgtgccaggcacgtgctgctgctttcacatccctcatctcctggaaccctcctcactacccccccctgccctcggggagcctgcacatctctccaggccacaccgagagggaaggggcagagccagcgtgaatatcaggtcactggccccagatccagggctctttcctctctggagcctgagctgggccggcacccagctggatccctgggcagaggcccagccagccaatgggaaatgccatcacggaggaaggcaccgaggaccacggggagtcaccaatgacacaagcaaagccagaggctgggctggccatgctgacccaagaccccgctctcctgatgccacactggggttgcctgcagggaggctggtgtcttgaaaagttgactctgagatagatattatagtaagggtcatttatgtgaaccacatgattagaagtccctagatttcttctgaatatcctaggattttccccagcccctcaaagccaacacgcccaagatagaattcaccattccaactgcttcccaagtcttcaactcctttaaaggcaaggaggtcttgcctctccccacccatcaagtcaagtccatcatcatatcttgacaattaaaaacagaggccatttattgagctaagaacatgacacctgcgtaattacacctgtgtgatgcccttacagccacccgtgggccaagcatcataatgcccactttacaaacacagacactgaagttcagggagaccaggcaacttgcccaactgcacagccagtcactcccccagctccgacacgaacccgagagtagccggctccagcacgctgctgctgtcctccatacctactcctcccaaatctctgaaaacgagcaggaagagggtgtattccacctcctttgggcctggccagaagccagcgctgatgagttccagaaggaggcctccccccctccccagccagagtggctggtgccggctggtgtgggcaccgtgccatcctgttctctgggaccagaaggctgcctgatgctcgctgcttgtcattctccaagaaaaggctgggctttgagcagagcaatgtggcgagtgggccacgacagtcacttcgagcctcacacacaactcagatacccaggatggagaaaggtgaagcctgacaagctgcctgcctccccagacctccccccatatcttcccttcccactgccccgagctgggttcaagccttcattcctccttttcacaactatcgcagtaacactgcttccagcttcctctctctataacccatcctccatgctgtggctggagcacaccactgccctgctcacataccttccactgttccctgtgcctttagacaaaagtgcaaattcatcagcctagttcgtgaagcccccactactccaccagcttcacgggcagggggctccatgtccctctccagtcttctcttcccagaacttctaggaaaacctacctctccagccctccctaagaacacagggcactctccaactttgagcctctgcccctactgttgcctcggctcagaacacgcattcccttttgcctcatgaagccctaccttccttcaaaacccagctcaacccctacttcttctaagaagcctccaaacattaatatccgcggcaggcccttaacgggatgcagagcctctctaccgcacttagcacagtctgccttgcctcagagttacggcagcccgaacaccccctcagcctcatccatctctgtgtcccccaacgtccccggggccagtgcctgccacagaatgggcatcagtgaaagtttgccgagtagaatgttctcagagcttcaatatattggtacagacctttccccgacagcaaaccccatcttttcctggggctggtcctgagctcagaacaaatgtttgcttcccgaggtggccactggggaatcctggcccactcacctcaagaggattctagcgatgcctgggctggcacacttagctgtttctccccctgccaggaaatctgccactcaaccagctctgtctcccactcacacagcacagaaataatagccctgcattttcctgcaaattccatcttccccaaatggagactagctccacctgttcaaggaaacacaagcaagaagcaagatggagcaggcctgggagaacagccatgtggcctcgcaggggccaatgggggttcctgggcaatgccccccaaggctattattcagtgctggactagaaagcggattggcctgctgcctccctttgccggcacatcacagctgactaagcatgcttcccatccgggttcccactcagtccacaccacagccccattactgtgtagacaccactgccccactcaagacaagatttccaaggatgaaaagacatggagactagaaactaaggaaaaacttcactgaggcatgaggagtcaggacttgaattcaggtctgctgactcctggaccaggctgcttgatgacagaggcagcccccttgggaaagggtgagggaacgagaggacctggaagggcaggctgcagttagaaatgcaggctccattttcgcattcatcctcataacaagctggtgagaatgagtcatcgaaagcagggtttctcagcctcagtaccactgacattgtgggctgggtaattctttgttgtagggggcatccctggcctctccacattaaaggactataatatccctctcctgactgtgacaaccaaaaatgtctccaggcattgctaaaagtcccctgaggagcaaaagtgccccagttgagaagctctgatctaaaggcacagttagatcccaggtcttgtggtaagggaggggaccccccactgttctccctcactcccattctggcaggcgcttctttctcccctactcatgccactcgccaggcatccgcagcccataccagttctactgttccctctgcaccatctccctccactctaggggcagagccaggcggccccacaggcattccttatgttgggcatgtgtcaagtcaccggcctaagctccttcattaacatcacttcacaaaactcctccaaggcaggcaccatcaccccaatgaaacagataaactcaaagattaaatcactgaagtcctgcaaccaacaagggtcagggtccagctttgaaactaagtcagaaggcccatgtccagcaggcctgggctgcccaagtgaggtggccttggtctacaggtcccaagactctcaccctccaagcccgggtgccagcatcagacaccagctgggctaggagaggacctcaaaagccatacctgctgcctttccccactctcctcccagtcttaaaaagaacaggtgcagtggcttccctgtgtggtccgtgagagccctgggccctctgcaggctttggacatttggcgacatggttggtgcacatgaggctggtgattcccaacatccagtgcttaccttcccccagctgggagaccttgaggaggttattccacctctccaagctcattaatcccttcccccaacatccctgtggagttgaaagtgctagaaaattaggaatgcatatctttagcgttttgtatcatttcagtaagtttccataaaatcaggcttccaggccacactgggggagcttctgagcatttatgacacattttattcatcagcccagagcagggagatttgaccttgaaatgtggattgactcagaaagaccctagcaacttccagtgaccttcagggagtcaacacccacggtgctggaggcatggataacttagctgatttttgtttgtttgtttgtttgctttgtttgaggcagagtctcgctctgtcacccaggctggagtgcaatggcactatctcggctcaccacaacctccgccttcccgggttcaagcgattctcctgcctcagcctcccgagtagctgggactacaggcgtgcaccaccatgcccggctaatttttgtattttttgtagagacggggtttcaccatgttggccaggttggtctcaaactcctgacttcgtgatccacccgcctcggcctcccaaagtgctgggattacaggcgtgagccaccgtgcccggccaaattttttttaacgttgccagccatgcctcgaacagacctctggaaggtgagaggagccatctgttctgggtcaggagcccaggcagaagcttgccacggcctcaagcaccatcctgtgacctcttacaacccctggggcaggtgctacacgcattatatggaaattgatacacctcaaacttaacgagtccaaccacaaactccctgtcttcccccaaaaaactgcttctcccacagtcttctccattcaattaacagaaattccatccttccagttgcttgggccaaaagtctcagcctcatccttgacttcccctttctctcaccactgcctgacctgcacaccatgaccttttgtccaattcatcaggaatgccctccttttaaatagcccaagggtccagccactttttaccaactcaatgctaccacccaggtccaaaccatcaccaccctcacctgagctgtccccacagcctctcagcggggctccctgaccctggcttgaccctccctgtctgttccaaacactgcagtcagagtggtcccattaaaatgtaagtcagatcttgtcacttctctactccaagccctcctcttgctcccatctcacccagggtaaaggccacactcctcaggacggtctacaaatccctgcagagccagacccgcctcccctgtgacctcacaaccccgcccacatgatccctccactcactgaatcagcctcacaggcatcctctctgctcccaggcctgcaccgtccagtgtgaggacacgagccacgtgtgtccactgagcccctgcaacatgaccagtgcaactggattttaagtccatttcatttaaaattaaatataaaaagacactccactcttttattggaaaaattttaagtacgttttcaacaacttgagtgtgtgaatctattcttttttttttctcggacggggagtcagggtcttgctctgctgcccaggctggagtgcagaggcacacgcatggctcaccacagcctcaacagcaagctatcccccacctcaacctcccaagtagctagaaccacaggcatatgccacacacccagctaattttttttttttttttttttagagagatagagtctcactgtgttacattacccaggctggactcgaactcctggccttaagcaatccacctgcctctgcctcccaaagtgctgggattacaggtgtcagccaccatgcccagcaagtctgttcttttaattgtaaattttataaactctaaatacagatcaagtatctccaatgaaaacttaatgtctgattgagatatgctgtgtcagagacacaccagatttcaaagacttagtacaaaaaataaagtgtaaaagatctcaataattttttgtattgcttgcacattcaaataataatattctggctatgttgggttaaattaaaaatattattaacatgtataattctacttttctcttttcactatttttaatatggctactcaggaatttaaaatgacagcggtagctcccatttcgtgtccaccggacagtgctgtctacaacacaccaggcatgatcccccctcagggccttcaccttgctattcctcttcccccaggtggctggatccctcaccacttcagatcctccaatagacatcacctttttggtaaggccttccctgagcacttatttaatttatttatttatgtgtttatttttagagacagggtttcacatgtcacccaggctggagcacagtggcgtaatcacagctcactgcatcctcgaattcctgggcttacgggatcttcccaccccagccacccaagtagctaggactacaggtgcacaccaatgtactcagctttttttttttttctgtaaagatgagagtcttgccatgctgtcctggctggtctcaaactcctggcttcaagcaagcctcttgccttggcctcccaaagtgccaggataataggcgtgagctaccatgcctggccctaagcacttctttatttgttttatttgtggtttttgttttctgtttttgtttttgtttttgtttgagaccaggtctcactctattccccaggctggagtgcagtggcacgatcacagctcactacagctttgacctcctgggctcaagcgatcctcccacctcagactcccaagtagctgggaccacaggcacgcaccaccatgcccagctaattttttgttttgtttagaaggcgtctcactatatggcctaggctggtctcaaactcctgagctcaagcgatcctcctgcctcggcctctcaaagtgctagaattacaggcattagccactgcacctagctctgagcatttatttaaaatgaccactctcagccgggcatggtggctcatgcctgtaatcccagcactttgggagggcaaggcaggcagatcacttgaggtcaggggttcaagaccagcctgaccaacatgatgaaacccagtatctactaaaaatacaaaaattaactgggcatggtggtatgtgcctgcaatcccagctactcaggaggctgaggcaggagaatcacttgaatctgggaggcggaagttgcagtgagccgagatcacgccactgcactccagtctgggtgacagagtgagactccgtctcacaaaaaaaaagctgggcgcggtggcttatgcctataatcccagcatctcgggaggccaaggcaggcagatcatgaggtcaggagatcaagaccatcctggctaatatggtgaaaccccgtctctactaaaaatacaaaaaattagccaggtgttgtggcaggcacctgtggtcccagctactcgggaggctgaggcaggaggatagcgtgaacccgggaggcggagcttgcagtgagccgagattgggccactgaactccagcctgggcgacagagcaagactccatctcaaaaataataataataataaattaatttgaaaataaataaaataatatgaccactctcctctcagaagcccctgcactcccatccagagtggtcctaacaattgtgattgttattgatgatgacaatgatgaaaggaaaagagatgtctttttcctgttatctaactctggctgtaaaattagttggggccttaacagattgggatctaagacttgtcaatggagtaagaagttgtatcttggagggaagaggctcttcataacactcatcatagcacttatcaccatcgaacataatatataattaacttagatagtttactatcaggcttatctattaaaatgtaaattcgtgacagcaaagatttttctcttttgtgggttttttctactacagtcatgtgtcccataatgacatttcagtcaaggtcctgtacaattataatggagctgaaaaattcctatcacttcgtgacatcttgatgatcctgaacctgtgtcagcccaggctaacgtgtgtttgtgtctcagtttttaaccaaaaaagattttgtaagtaaaaatgcatctttttaaataaatatttctaaaatggaaaaaaacttatagagtaagaatataaagaaaatactttcgtgcaattgtataatgtgtttgtgttattacaaaagagtataaaaagcttataaagtgaaaaatttggccaagcgcagtggctcatgcctgtcatcccagcactttgagaggccaaggcgggtggatcacttgaggtcaggagtttgagactagcctagcctacatggagaaactttgtctctactaaaaatacaaaaattagccgggtgtgatggcacgtgcctataatcccaggtactcaggaggctgaggcaggagaattctttgaacctgggaggttgaagttgcagtgagccgagatcgtgccactgcactccagcctgggctacagagtgagactctgtctcaaaataaataaataaataaataaataaataaaattatagtaaggtaaggttaacttgttattgaagaaaaaaatattttaaataaatgtagttagcctaagtgaacagtgtttacaaagcctacactagtctacagtcatgtcctaggccctcacattcactctccactcactcactgactcacccacagcaacctccagtcctgcaagctccattcatggtaagtgccctatacaggtgtagtattttgtatccattgtacagtatttctactgtaccttttctatgtttagatacatacttgccattgtgttatgattgcctacagtattcaatacaggcctgggagcagtaggctacaccatacagcctcgtgtgcagaaggccatgccacctagtctgtgtaagtgcactgcatgatgctcacacaatgatgaaattgcctaatgacacatttcttagactgcgtccccgtcgttgcaacgcatgactgtatatctgtgatgcctagaacaatacactggcacataacaggcattcaataactttgtcaaatgaatgaaattatttttccgcctgggctggctactcagctggaagtttctaagtgtctagcatatggtaggtgcttgacagatgcctactgaatgtcaggctgatctgttagcagggtcattggggaaactgaggcagcttagctgagtgatcccacagagagcaaaagcaagcgccaagggtccttgagtcagacgtggtgcctcctcccgctgccacccatgctccctctccccgccctgagggaagctcccctgagcccaacagcctcaggtacctcggggaaaagtacatttcttttcctttccatagacttttattctcccagtgagaagacaaatctgtttcccctccaccagaaggcctcaagccacagctacttacattatagtaattaaatccctgctgctaggagggttcaggagacaagcaggactcgtgccaagggctggcctgcagggaggaggcagcagggagggaggctggccagaagggcctgtctctcagctgtctcctgagagtgagaaaatccccttagccacgatgtcttcacaggctttcgcttgtgggataggaagataacgccccccgcagcccaccctgccaacatgcaccatcgatgaggacccccgccagctggaatagcgtagctttcttccagttctctccgaaattccatctggtgctcacgaccttcccgcagatggccagtgcaggaaacatcccctcctcaggctccttctctcactctctagatgacaaaacagaggaccagaaactaagctgccccacacctagcctaggatgcttctcctcacctgcaactcagctggccttcacagagcgctccatgtgtgccagaaaccatgtcctctgccttacaaacagcaatatctcattaactctcatgacagccccagcggccaggttaggattcacccccatggaaactgtgaatcaaagcactgagacagcttcccaaagccacacagcctacagtaagtgacacagccagcgctgtacccaatatctgcttggcactaaagcctgttctcctaacaccaggctagatagcccatatagaagaatcagaggatggcctgggagacagatatgagggaggatggaagaagtgagggtgagatggaccttcaggaaatggggggaaggggagcagacggaggcgtgggacaccaagtctcaggcttgtgggtcaaacccaagccacatgtgtgtgcccttgtctctcgcaaagctcacatcagacctgttgttacttgttcagtgcctgcctcccccaccagcctgtgagctccatgtctatttggtgctgaacccccagaaccaaccagaacacgccaggcagtgcccttgtctcatttattcctcatgacacccattctcatgagagagagaaaacactgttaaccccattcacagacctggagactgaggctcaaagaggtcagttttctcaacaaggctgcacagccgagaagccacagagctgcggcaagaacactaggacgcatgctgttgagggctcgggtggcccctccagggcccacaggagactttcctcagccccagagcccagcacggcacctggagcttcagcaaacccctgtatctaaactgccagcatcctcctcccctcctccctctacccttaccccactccatgagcacaaaacatcccctgaggctctgggggaggctggcaggggactgagggtggcacagtaaggggtggggtgggcgggagtggagagctcaggcagggcaggagaagctttttggcttgaaagagcccagtctaggatctgatatgcaaaagcatgtctgctgcacaatgtgagggcgtcggagacactcccctgtgtgcaaatccaaactccaccacctcccagctgtgagaccctgagcaagtcacttaaactctcggagccttgggtctgtcatctgtaaaatggggagaattatatctacctcacagggttgttgtgaggacttaatgagatgaggtgtgtaaacacacatagtaggcccttaataaatattctcttctccaccgcctgtcacctcttcactcctgaataagacccggtgttgctttggagtcattcttacggaaggaaaaataagttcccatgtaatgagagcggtgccttcccccaagctgctgtggacacaggctttctttctatatgatcccgtccacccaccaggaaaccctcatgactcaactccatcctagacttgctctcagcttgcatcaatttcatttcactcttaagggatctttccatcgctggcacatagtgtgcaccccgtcaggtgtcttctgccaaaatgccctcccaccaggctcagcaccattactctcccagagcaggggaaagcatcttggcagagcttaacaccaggtccagcccagagcaggaggggctgggaaccatgggcccagctgtgagggaccttgcatgatcccaaggccactgagctctcagaagaaacaaccaaggtaaaacccaccattgcccagcatggacaagagccccctgggtgacagctctggcccacgttgaattcttcacctctccacccacaagaggaattaaaataccacctcccaaataaaggggccgctgcgcaaggccacacagccaaatagccaggatttgaatccaggtctatggggaaagcctgtgctctcttaggaagagttggtggagaacaacacatctggctggggagagacccccctggagtctgtaaggcacagattctctgcactcctgccgcctggagcagggcttgccacacagtgggtgttcaggatatgtttccagaagagggatgggagaaacaaaaagagaggaagaactaaaaccaggaattccaggattccagctatgcccctgccactaacaatgctgagtagcctcggacaagtcatgtaacttttttttttttttttttgagacaaggtgtcactatgttgcccaggctggtcttgaggtcctggactcaaccgatcctcccgcctcagcctcccaaagtgctggattacaggtgtgagccaccgcataacttctatgggccttggggtcctataaggaggaggatggtcctttccctgccttcctcacagggctgggaggcatatgcagggatcttgcccacccaggctagcacacctggctggcctacagagcttggccatctagggcaggtatggtgcccccctgaggaggcctcccctgcatcctccaccaatgccatccagctctgagccctccaaaggcggtggctcaaccctgagcaacatgcctaccccaagccctcaccttgggagaaggtaacatcacccatgcaggcagctccggccattcccatgtatgggagatttttggggagccaacatcttacccactggaagccagaaaagaaagaaaatagctaaactccaattcgttaaaatcagaaatctcaaaaggggttttgctctgcaaaaatcgctgctagtggaagcttgcgaggaggcaggctgatgccaactcaggcaaaggggctaggaggagccaccacttgctggcagcccaggagcacccacagccaggctggccacttgaccaaccactagcaagtgtcatcctccccaggttagtggatgtcagtctccccacatccattacaaacggggacactgaggctcggagagtttgaggcacagagcttaaggaaaaccaacggtggcagatggaccagaatgagcaagggcagcctctccctgcctccctgcagggccccctcagctcaaagccactgacaggtcagcaaggttcaatggctcaagccaggcaacaggtcatctgcttcctcctccctacctactgggtaacctgggcagggcacccacctttataggtctctccatctataacctgaagcaaaacaccaaacaactgtccttgcagatgtcgcgtggcaggcctggtatcagcaagctctaaggagtaggtgccagctcagtccctgcaaggagtgtcctttaagctgactttcctgttaatttgacactgagcag

SEQ ID NO: 2521 - DNA, 172814 bp, Homo sapiens
tttggttttagtcagttctcttcttgtttttatttaatgccataatattatattagcatatgccgtaacatttaaaaatgcccattctctccagcttcagttcaagcaggagtggggaaggccatagactaagcccaccttcaaggtcacacttccatattttgcacagagaagaaaatgcagtctcccatccagatcctcagacccacacaccagcccaccactctcattccagatgccctaagcctgggtctggacacatgtggtcaatacacatcctggatcttacaaatccaatggtggccagcagtagaactgaagcctgtaagttttcattcactcctaaagtgtgctgagaaatcctagcctgttttttccatttaattcctgtagatgagtcatttgctcctcagttttctatggcccaattttcccattggaataatgggaataatatgtcatccaccttacagggtgatgactaatatattggcatttgagatccttagatgaaaggtattactgtgtataagtataaagtactattatttagtaatcactgagttggtaaatgtattcattcatatggagtttttggaggaagagctttaaggaatgacagcagtagaaatgcagctagatatatttttgaaaacattttttaggtctaccaacttagaaaaagtcccagatattacatactccttctaaagcacctaatttgcatttttattattattattatttacctagaactacagaaaaatttatgggaaggaaagtaagggtacagggttttcaacttggggaaattcatttcccatcccctggctgccaagccttcctactcacaattccacaaatgtgcctgcagctgtgaggacagctggagagatctgttgtctttctggtcacctctgacattttgcagtgtctcttctgattgacactgtatacagggcatgacctctctgacttggccctgcctattatgaaagtgtcaccatgggggcagggagctagagagatttagttggtttaaagaagtataatgtgtccttgagctttgagcacagcaatggaaacctggcgactcttcctggagctctagggacttctaaccagagcaagttggttcattacaagctgtcacaccacagaaagagaagacctttggctaaggtagagaaaggctgactcatacaggcagttgtataactgtagacaggcagggcccatggagctgtggagagttcactgggactcctctgccttctaagacacaggttcccacctgcttcagggagagagacttcccactagtccaccttctgtgtgtgttaccaaaaggaagccatatttggagctggtctaagctccagcccctgcaatttcatttgcctttccttagtaaggaacacagtaacaacgcgaacaaaaccacacagagcatgtgaagaccgggcccttctgatgctgatgtgtggagaaaactgggcactagactgaacaaatttttagctattgccttatgggaaccacagaaatggattgaaataaaacttacaaaatcactttaaccactcttatttatgcattaccaccaagggaaaacaaagtcactgaaacagaaaaatgttttccaaaggaaaaatgtttcctctttggtgacctgagaaagtttaccgtaactccattcaaaaccttcaggcacttgacttttttttttttttttaatatcctttacctttttaataaaaagtaaaaaacaaacaaaaaatacatcaatgttccgaatagaacctctctatgtaaaggtctcactaaacaaataaacataggaccagacaaaagaaatggagctgtgaatagcaatatgatatattatgaagcatttatatatgtatgtatatattatatatgaatgtgcgggtatatgtgtgtgcacctatgtatgtataaatctgtaaatatttgcctacatacacgtcacacacacacatacatatttatactgacctctttagattgaagtccaaggcactttttacaatgaacaggttaaagccattaatttagaacataactgtttctgggtacatatcgagttatggcgccaatatcagaattcacgtctttccttgcccaccttggagtgtttcttgttggtgcaatgagtaagagaattggctttcaaggagattagcaatgtttctagatggttaaactaacttctcttgctattttcctctaggggaggggagttcttactggtgagatgctgagttcctcaagggaagaacacaaggatcgagaaacacaacaatttctgtactatgctaagcagagactcctgtagccttccagaggacctgccctgaggttccacctgatattctgatggctttgctagtctggtctaaaaaaaaaaagactaaaacttaaaaatgggggctttgaggtggctcaaggatatggagtgctatttaggtaagaccggaaaaagactatctcttattgactttattatgtttgatgtagaccatccaagttatataacctcaagtggaatttaaagatgcatttttttaatccttatgatcattcaggaccttcacatcttcaaataattctgtaaatgagactcaaggaagagatagcttcattctctaattattaacgaggttagttatcactacggtgaggtgaggccagtgcttatcaatatttctggtgcatacaggtcacctggggatttgttaaaaggccaattctgatgaagaaggtttgatgtggggcctgagattctgcatttctaacaagcttacagatgatgctaacgctgctggtctgtggaccacactttgagtagcaagggttagcatatagccatggacttgaattactgtcaagaggtctgctttccccaaatgatgaatttgcatttgtttccttgattctagatggaatacaactttgaggggaaaggtcagaatatatttgctctttataaatgtaagtcttggtctgagcagtgttagaaggaaaaaccaaaagaaaaaagcacttactgggccaggcacagtggctcactttgggaggcccaggcaggtggatcacgaggtcaggagatcgagaccatcctggttaacatgatgaaaccctgtctctactaaaaatacaaaaaaattagctggtcgtggtggcacgcacctgtaatcccagctactcgggaggctgaggcaggagaattgcatgaacccaggaggcagagcttgcagtgagctgagatggcgccactgcactccagcctgggcgacagagtgagactccatctcaaaataataataataataattttaaaaaagaaaaaatcatttagtagcaaaaaaaagtgaagaaataaatcaattaccaccaatacattcatcagtcaattgtaaaattgaaaataagccaatttccattatccggtgagtaagtaacctgataaaaacaagtgccctggagttcagatggctttagtggagctcggcctaacatataactgaggagtaatacaggcactgagagaatttagctccataacaagaaaacttgtgtacaagttagggctcagctacacaaacagactgaaaacgggcatttagacatttctctttcaaacagcatgaatacctaatgtcagtgagccccatgacttatatacctttaagctcatataaattgaaatttgaaggattccagccttttcccaggagaaaacttgttgttttgcactatctgtaaatctatgtgaattttcagggcttgggaagggaagagacacataggctcagttaatctgccccgatgcaacctggtttgcacctgtacaatattgcaccaaagcaacaacagcaagtgagggtcccaggtgagaagaggctcactgattctagaaaatctttattctgtaaccgaacacatcctgttttcatctagaagtagtgccttagccatatgaaggagggaactgagaacttctacatgtatgtctcagctgctctgtagagaaagaggggtgtagattccatgagttgcttaattttgctataaaggacaatatctcaacgggaaccctttatttcctcccagctagaggaagctagcagaaaaggcagcccggctctttgctggctctggctgttcatgtcctgccggctcctcccatcactcccttaggagctgggctccatgtccttgataaacatgtgggaaccttgctccctcaagggtattgccaatttagaaaagcacatctgcacactggactcttgttgggccttgtgtagtttggaaagccgaccccggtttcacgtacatggagaaactcagaatgcctaggattttgagtattttaagttacaggaaaacaggactctttcttatgtccaattctgacattgtcaaaggaaaactggttggctaggtttgagacttatataatttatgtaatgaggcctttgaatttatatagaaagagcctgaacttttattaaactggctttgcagagctactaaaggagtgatggcttttaaaatctcttctgaaatggcttgatagaatttagggtagaattattcctctactcttggaataatgttcttttgtctctaatacccaggccttggagaattagaatatggcagttcagtaggctgtggtaggaggaccctttttctgggtgcccggcaatcactaacagtgatgtgtactcagaaacagtcattgggagagcaggctgacagtggacctgctaaacactagtttgatacaaaatgttaattgaaagttacaatatattttataatatatcaatatatttcatatttaaaataaactgttatgctttctcctatcattaaaaaatagcaagcagtacagaggcaagatgcaaattcatattaaagctcatctgattctgaatataaacacttcagtttctgagcttgccatgaaaatgtttcctccattaacatcctgtcattctcttgttgttctcgtggccagtgcagaatggagagtctgggaccaaaattgagttgttgcgccattaaaaaacgtatctgatgaaggtggatcagtcctggttgagattcaaaaactgagacaacatgacacagctagagaatgttgtttattccttgtccttcttgagtgaagctggacgttggctgcttcgatctgattcagatatatatatatatatatatatatatatatatatatatatatatatatgtactttttctttttggctataaatgtcaacatctctttgggatcctaactgcaggttggagttgaattttgtgcttttcctccaccagcttggttggtcacgatgtgtctcttttgcttgtttcaacacatagcccaggcccaagattacagcttccaggatacatttttcaggtgtgtaaacaactgtcacagggcacttggcacctagatttggaggtcatatgttgaagatttgacaatggttttgttcagagggaactccagttcacgtttgggtgtttccagtaatggcgtaagacaaaaagatcacagttatatttttttctatctgtatatatgtatataccattgcactgagtactttttaataagctgtggtctgtttcaataaaaatctacatattactcgtctaacaggagtttaacattaatttctattcatgcagcctggcacaagctttctactaccacaagcagacagttactattgcgatccctgtaaactcctttctcagtggtgttaatgatcccatttccctaatgtttattttggcggcagtagagaaggaaaggatactgtctggggcgtcatcaagcccaccgactgcaaggggagagaaggggttgttcgtgcctactgggaagtcaccagatagctgtctaaggtactgaaatcaaaccctgcagagtcaatagggatccttcatctgcttctagcaactcttaggggaagaagaatgaatgtagaaaactggggacatattttaggatttaaaaacagtaacttcaaaagagtagtaacctactggtagtgcaatgacttcacagtatctcagttgtggtactgtgatgggagcaacaccgtttgtcctgggatgaaacattgattcttaatttggagtgtactgtttgttgagttgcactctggaggaggaggaaggttctggaactacgtgctaatcccatatttctccctgctgattttaccactatttaatgtgcactaattactttttggtaactactgactgcattcaaacgtaacatcaaggtgtgatctagatacagtcagtctgggctgctgttgatgacaaaggtgatttcatttgttctctattgaaaacattgtacttaagaatattaattattctcttcattttaagtacagagaaattgatgtattaggtgcttatatgaattggccaaagatgtggatccagtcttaagatttttatttattctgattttgtatgactaggtttcttcttttccatgattgtttattcacaaggaaattataaaaatttaagggggaaatcccccactatattaaaatcattacttcttcaatgctcttccttcttggcttttaataataaaaatagcttgtacatgctcagcgcttggaatttacttttgcgtacattttctatgtctcctaattcacaagattgttgttctaccactggcccctgctgaggtcggtcagtggtgacttggggccttccccccttgttcttttggattgtattaagcacttctagagacatgatgtcatgaagttacgtattaggaagatggcaagagcagttcatagacactttatgacaatttattgatgatgatcatatatatgtggcctttgatccaaaggtgaagacttttatttggacttcaatctaaggaggagtgagcccctagtctggtgtaatttaccaactaatgctatgtcctgaaattccactgagattagtggtcttaaagtatcacagtacatccctgactttacagtacatgaagctttaatatggcttaagcaatggcaggggtgggggtggttctgtatttctaattcaagtgtctagatattttaggaatattagagtgattttacctgtcactgagttgtcagaaagattatagtaggggatctgccattgggtcagtcctctaggagtgggcagatcttgatcagtacagtattggagtgaggttacataattaatagtttttacatatagccgattttttttttttttttgagacggagtcttgctcggtcacccaagctggagtgcaatggcacgatcttggctcactgcaacctccacttccggggttcaagtgattctcctgccgcagcctcccaagtagctgggactacaggtgtccaccaccaaacccagctaatttttgtatttttagtagagatggggttttgccatgttggccaggctggtcttgaactcctgacctcaggtgatcctctcgccttgcccaaagtcctgggattacaggcatgagccaccgcacctggctatatataccagattcttgagcagataattaaacctcctccaccacaaaacttgaaaataaggtacaagaaggcatgacatgagaatccacctgccccttttcccatctgactgtgatgctgaggtgtggtggaattagccaaaagatgtaggaagaaaacttgggtgagctacacccagaataattaatacttaagtcatcaagggttgattgtacttgcaggagaacgggtaactttcccacataaagctgaaatgctagtacagagaaatagccttccatttgctattacaggatcaatgtgcaggtttgatcactttttttttgaagcattttcttttgccaagaataaaaatcatgtatagctattgcactaccaataggtcaattcatgctacaaatgtccatgtgtttctaggatgccagtggctactgctaccagaaataactccagtcactcccttgactagtgttgctagtttggtctttagggtttacctaagtgagagcatcaatgatgggttaaagtcacagaccacaatgaataaatcacagtctgtgcacacttttggccaggaagagtggcagtggaatcttgcatgtcatttggttgaaattaagactaaatctctatatgtgcacacacccacactcacacccacacgcacacatatcacagggttatagcagaatgaaaacggtgggtaggaatcaccagttgaaggctgtaggtttaaatgatcaggattggcacactcagatcagcccaccagtggtcttcactttgtgaaatggaactaatgccacaaggaaactgcatggttacttcatctgtttacacatctgcttatatgttcagctgaactgtcactgaaaacaggagcaccattcttgggacatgaaacaaggaggaggggaaacattcagataatcaacagttaatagaacaagtaaaaaaataagccaacagcaggtgcggcatctctggtatgcaaaacaactaatgaaagtgttcaaaggaattatcaaggcaggccattaagactataaaccatcaaaagagcagcagcaatagcaagagagaaagaagagggttagcaagagactagatcttcctgaaaaagtggccttggctctacaattgtctaccttgtgctgtccttagaagaacaggcccagtgctacagaataaaaatctccatgccaagccactgccttcagaatggtgatgatgtcttcttacaaaggtaaacccaagatgacaaccacaagcaaaaaaatcacccttttgttttaccatcaacagatgaaatagtccatacagtgccattcaatttcccacaggcagaaaccaaagacctcagaatgagaaagtcatggttttcacgtcacaaatgttacgtgtggtcagattatggagcaatgaaaacatttttctgcgccgctcattacactaaatcttgatgtttctgaagtctcttggagtttgagatgtattggaatagtttttcgcaccaagattaacatggcacagtaggaacaggctactgacaaatccatgtccacttaccttacccacaaggttccctaagggttcccttcattctcacaatatttcattttgagatgacttaaggtcaggtagaagggaccacataggccactcttcatcacttctcctcctagctcagaggctcacaattgaggcacttggcccttttgcactactaacatctggggctggaaacctgttgctggataaatacagctcagcaaatccccaaccatatttctattcactaaggtgttattggattgctcctgtttgtgcatgtctgcacacacatgcacaatttcttgtcctctccctccacacttacagacatacacctggtcatgtggaccatcgaaacacaacttgtttggatggaagaagaaaactctgcagatgctgttatttttagaagcctgcttatccctcctgaatgccaacaattttggcttggcatccatttcaaatcaagcaaggtgcatatccaggacaaagcaatgtgcattatgtctgaagggatccacatcttcagtgaaactcagaatgtggccagaactagctaactacctgaactgaaagcaccccatgttcagattcagaccaactcaaaacacatgtaaggggtgcctattgtatgcagggtaaggtgtcaagtccctttttatttggattaagctcaaataagaaaggacctgaagcgaacgtgggatgtgtatgtgtgtacatgtacacgtttgcaaacacacaggtttatgtgggtattaatatcgagtggaaaatctggctttttatttgtctgtgtctttttttttttttttcagtctgattcgagtatatctgttttggcaagttgtgggcagctctcttttacttttgtcacccagaggcttccgtagacaaaaggaaaggagagaggtgtgttcaaagacccccatggcgaagagcccatcccccaagcctgacacaaccctccctcccagcggacccctcttctggactggcttcgctgttggctacttcagtgcatctgacccccaccccccgcgtgaagacctgagattgagcgtggatttctgttctccaccaactctgcagcaagggccctgccagaggcgtcgcttcctgtcatctcctcttcccgctcccaagtagaggcacctaaacagagattagatttctggtttcaaggcatgtcggaccaagcacgctgaatgaacatgagttagttaattagctcggtctctcttctttccgttccctggtctgaatgtttcttgatggcaaagcgaccaggagagagttgatttgcatcttaagacctatgggtaatgcttctggagtggggagatttatttagcaactgcttgaacttgtgtacggggtcgggaaggaggtggagctgaccccaatggggctatcggagattggggtgtgggtggtgcccactgccacgctgacaccccgggcctcgatgatggcagacaggagctgctgctgctgctggcgcagggtgtcggcgatgagcagcggcagggagttgaagctggcggtgagatgctccagcttcgactccaggctgccaatctgcttctccaggtcttcgctccggtcattgagttctgtgattaagtcatacatgacattctgcatctgtgtggagagagagaggcgagagacagggagatgacaggtcatcacagaggaatctgcaatgggagaaatgaaacgccctccacagtatgacaggagccacttccacaccagctgatctggtcaaggaaggatacaggcttctttcctggggatggggatgctgaagtgtgcacatttttgttttcttattacaaaagtaatgagtattaatgacagcattttattagaaaatatgcaccaaggggaaaaaaatggcccttttttttttcttaaataaagtgagtctctaaactgtctcatgttctcacagggccacaacctctcagctcacatggctgctggcatctaatgattccagagaagacgctggtggggaatggacagtgcagtgggtgtataattagtaggccagggctcaagtacacatctgcagctcactaacagtgtgccctctgccaggcgcctggcctctctcaatctcggttgccttataaaattggagttaataataactgtacacagttaggagttattgcacatctcccaacctctattttaacccagcagacaggatgtaaagtgaattaactctcaggcacagtgcttagccaaaggaggctgccttgctgaggtgtggcccttcgcctgcctgatccacaatgcctcagggtgggacatccctgaagggccactctgaagggctgaggtctttgttgactgtatcacagttcaaaccctcccactgaccaatcctgcttccctcactccttggcaggggtcctgagggtgctcccctgagagctccccagtacccctcctgcactcagcactgactccccgtgttccaggggtgccggccgattaccagtgctccttccccaacatcctgtggcccccttgttggtctgcagagtcccagtctatgcaacagatatttttctcccagcaaattagcaaatgccatcttggctgtgtacatcagacttgggaacaagattcacaagcatcttcagcctcccacgtgtcagggagtgaggctcctggggcggcaatgcagagggccaggccggtggttgcttggtcatccctgaggtactgtggctctttgggtttctgatgatctgccagtgacaccccgatcctatttcacgtgaaatttcaggttactctaggaagatatggacatgatttatgccccagggaccaaagcagcagcaagtaaggtgagaggaaaaaagaagagtaaaagaagatgtgagaagccagagaagaatgaaggggagcaggggcacaaaatgcagtgaggcctccccagcagactacaggccccatgaggaaattcactggggcagcataaggaaaggtcacaaggtggcatggagatggccccgctcccatgagctctgctgttgccagagcaggacaccgtgtcgtggatgcccttggaggacagggtgactttagaagtgaaagtactccctttattaatcaacatgacagaacctcctcgaggcaaacattcttcccggaatgtgcaaaatcacccatttcatttgaccgcaggggcaccctgatgagctctggactcagagtccaggcccctgggttgtggcccccacgctggtgctcaccaactgcctgaccgtgggatggtcactttgttcccttggatcttggtttcctcatctatattgataatcagaactaccaattgcaaaacctttatagtttacaaagcattttcacagatatcatcttattcgatcacctgagcctccgatggtaggaattatttttatatttcaattgaagtaattgaagcaatcggggaaagactccaagccctcccagctctgccagcctataggacagcaattcaatacagacgtaatatgtggaggccacatgccatattcttaatttagagaggaccaaagggcaggagtgggaaggcgctgacttgggaggctacagcacaaagacagaaaagagagagaacacagcgttattgtctccccctgttccgttgcttggtgacaggatgccagggggaatatggaccagtgtgaagtgtgctaagctgctgccaggaccttgggtgagtctcctgggaggaaaagataaagactgggcgaatgtcagagttcatctcctccccagatctccccacgggggttctgcagatttttcccttaaccctttcctgcacactctttctttccaggtaacttgctcctgggttatttacggcttagttcccccacccaattcacaggagtgtctttccagttcactgaggggttcgcttcacccggtctgctccgtgggccccatctctccaagaggccgtgggtggcactgcagaaatgcaggcttgaaagtttggtttgcccaaaagtgggcgaaggatatgaacagacacttctcaaaagaagacatttatgcagccaaaaaacacatgaaaaaatgctcatgatcactggccatcagagaaatgcaaatcaaaaccacaatgagataccatctcataccagttagaatggcaatcattaaaaagtcaggaaacaacaggtgctggagaggatgtggagaaataggaacacttttacactgttggtgggactgtaaactagttcaaccattgtggaagtcagtgtggagattcctcagggatctagaactagaaacaccatttgacccagccatcccattactgggtatatacccagaggattataaatcatgctgctgtaaagacacatgcacacgtatgtttattgtggcactattcacaatagcaaagacttggaaccaacccaaatgtctgacaatgatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacaccgcatgttctcactcataggtgggaattgaacaatgagaacacatggacacaggaaggggaacatcacactccagggactgttgtggggtggggggaggggggagggatagcattaggagatatacctaatgttaaatgacgagttaatgggtgcagcacaccaacatggcacatgtatacatatgtaacaaacctgcacattgtgcacatgtaccctaaaacttaaagtgtaataataataaaactaaaaaaaaaaaaaagaaagtttggtttgcctcatgtccccagggaacatcagtcacagcatgtcctgcaaggtgagaggagaaacaggaaatactgctactcatggaagaaacatcctggggcagtttgttgggctattcctgaagctcacaggtgggcccctagccctgtttgctccatatgaccctcttcctggccaatgctgattggtcccagggtggatacgtggcccaaattggccaatcatttcttctattctgagaatttagaattaagactagtagggggccaattagtctttacctgtggctaaaactattatatgtactctctgaattggagcctgttacagtctgtcgcggggacaggaggcagagagggagagaaagagaggaagagagagggagaggaagagagagacagggaaagggagaggaagagagagacagggaaagggagaggaagagagagacagggagacggagaggaagagagacagggagacggagaggaagagagagacagggaaagggagaggaagagagagacagggagagggagagagaactgaagcagtcacttaaacagaaggacagagaagaaatggtgagagacctcctggttgtgggggcttcccaggtctagttcgagtcagttccttcctgcagtctggccacatgtctcctttgaggttttgcctggaatgagactcccttatatccttagaatagatttctccatttttaaacctagtcccagcgggtttctgatattaaaaccaacacacccaaaaacctgagggagttctctcctgcatgcccacgttccactcccaccccaggctcctaggaaccaccctgcactccacgtgaacgccctcctccaaaggcacgcgggcctggaggcttctccccaaatgtgccaagccacttactccccgattgaagtcctcacaggtttagaaggccctttctttggttcaatccctttattaaacaaggcacctgcacgtggcccgacaactagtgatttctctgattgcactcttttcaaagggtgcttaatgtgcctgagggagtttctcttgcttacccagggaatgtgttccattatgataattgacatctgctggaatgttctgccagcctggccctgggctgtacacttaatatacaattcctatcaagaggcaatgaggagagggggctgaggagggggaggccctttcttcagtggcaccgactctcagctctgccagcagtgtggccttcggctccctcacctgggtgatttgcaagaggagtttccttacagtatttatggcagctcagggccagaaacagagtggcagagtgatggcgagccttacaccctagggctctcaaaagagggctctctttttgggtatcttcatgttccttgtaggctatctgcctcttgagaagtaaagaaatgcacccccccacacacaccactgccgccaatttgaggccagcaaaactagttggttaaggactggaggatgtacaaaaatgaacttccaagtattacagcaaaccggtgtgacctgggcagttaccatggccatcgttaccgtctggtccttgctagcatgcttcacagccgtgcaaactcaagcccaacctcaggagtccctcaatgtgcagctcataaaatgacacggaaaaggtttagtcagctcattaatttcacgcagagacacacctgagcgatttcacttaagaaacaaacaccaagtttcaaaagcccacaagacataccggtagattgcaaatgaaacaaacttgagcctaggtatttttgaaccaagcagaaatttttctttgcttgcctggtcccgcgctgtccagtgcgaacccagccaggactcacaggtgagcctgagaagactcagtgtctgcgtgttctaggggatgtctccagacactgccactcaccttggaaaggtccaccagagtgttggcttggtcactcagcttcctctgttccatcttgacgctcctcaacctgtggggaagaatggtaacaggcaagcccttcaagtccatgcaaaggtttagccccaccagcagatcctccagccctaccactgcctctgattttggaacccagcatggggaccgtgaacctggggaacaactgaggcttttactttccaggggcttgtcacatccccccagaaagcaaactcttgtctccacgcatgctcaccttcagtcactggtttcttgctattcccagatcatttccctgcctctatgcctgggctgcaccttccatgttgagtgccttattctcaacttttcagggattccccaaacctctccatcagaatgaatgttttcatcctttgcttttccactatacttttaaaaactcctccatcacagaaagcatcagccacggtttgttttgatttgagttgcaatgcatggtgtgtgtgatgtgtggtgtgtgcggggtgtgtgtgtgtgtggtgtttgtgtgtggtgtgtatggtgtgtgtgatgtgtggtgtgtgcggggtgtgtgtgtgtgtggtgtttgtgtgtggtgtttgtgtgtggtgtgtatggtgtgtgtgatgtggtgtgtgtgggttgtgtgtgtggtgtttgtgtgtggtatgtatggtgtgtgtgatgtgtggtgtgtggtgtgtgtgtggtgtgtgtgtcgtatgtggtgtgcatggtgtgtgtggggtgtgtgcggtgtgtatggtgtgtgtgatgtgtggtatgtggtgtgtgtggtgtgtggtgtgtatggtgtgtgtgtggtttgtgtgaggtgtgtgtgtgtggtgtttgtgtgtggtgtgtatggtgtgtgtatggtttgtgtgaggtgtgtgtggggtgtgtgtgtgtggtgtttgtgtgtggtgtgtgggatgtgtggtgtgtggggggtgtgtgtgtggtgtttgtgtgtggtgtgtatggtgtgtgtgtggtttgtgtgaggtgtgtgtggggtgtgtgtgtgtggtgtttgtgtgtggtgtgtgtggggtgtgtgtgtgtggtgtgtgtgtggtgtgtgtgtgtggtgtgtatggtgtgtgtgatgtgtggtgtgtggtgtgtgtgtgtgtgtgtgtgtgtgtgtgtgtgtgtagaatgtgaaagctcttagaggttcttactctagtttttaccttccatagcagcctgcccaattcctggcatgtggctggtgcagtcagtgagtgatcagacccagttcaccactccacttgttgagtggaacagaatggatttcttctgtgctactgacagagttgtaggagtcccgccactcccagtctggtcatctgatggctgaaccgctctggcatactcactggtggatagcttggaggaacttcctctggtgtttcctcactttggcatggtcaatcttctttagcagctttgtgtgtttatagattaaccatgtttcccgaaggacattggctgcagcattcttgatctaaggaagaataaataaagtaggctgctatcaggttcattttcttaggttcatttttgtggttgctactgtagtctacctcataaggaaacgattttgcaatgatctattttcttaaccaaaatcacggaactcctagaaaagatgattaaggccgggcacggtggctcccgcctgtaatctcagaactttgggaggccgaggcgggtggatcacctgaggtcaggagttcgagaccagcctggacaacatggtgaaacccgtctctacaaaaaatacaaacttagccaggtatggtggcacatgcctgtagtaccagctactttggagactgaggcaagagaatcgcttgaacctgggaggcagaggttgctgtgagctgagatcacgccatactccagccttggcaacaagagtgaaactccatctcaaaaaaaaaaaaaaaaaggaaaaaaaaaggtgattaaaattcatctgttcttaatcttgtgttggacactgcagaccagagcttgaagttggagggtctttctttctttctttctctttctttcttcctttctttctttctttttctttctttctctctttctttctccttccttccttccttctttctttcttccttcttgattatttcaatactatctcttgactgctgttgctgatgctatatttagacaggctgcatgagcgagaccttgagtcccggggtccccttggaaaatagctagcgatataccattgctgcccttacatgcagacttccgagctttgcctgagattgccacttcgtgtatacggtacattgcttgggttcagagagtaaacagatttcctatcagctggagattttaaaagacttctttgagaaaatgtctttcccactgattggaactataggtaccaacgagcccattgtctcctttcccaaatggccaaaaacatttgcactgcaattgtacatgtaaatgtaattggcacaaaaaagaaataatttcagagcaatgtctgaaaatcagtgaagatatttaggtgtgaaaccagagcttcctcttccccagggctggctccttcactgtgcactgcaatcacacgtttcaacatatgacgctgtcatccattgacatggaaaccactgatatcaccaggctcatgactgagctgagacatatcaatggcatccagatggcaggggacaaagttttaatccaaacacagacatcttcagcaattagtaacaagagcaacagaaaacattccttattaagcacatgctaagcagatttttgattaaccatccccatttctgtcagccatgcagactggcatgtgtccacaggcctggggcctggaaataagtaggccagcctaatagaaatcaggttactagccagaaaggattttaataaaattagagaatatagacctgcttcttcagactgacatcaacagatgggatgttgttaaaatactgagatgtgtgggaagcctaggaaacattgttttgcaggctgataacttttgtgtgtgtatgttttaaaaatttattactaaggctggattatatttttcattggcgctgaagtgatgtttttaaaagaacagctaagtcttctcagaaatgtctaagggacataaatattgctttttaaaaattcagtaaagatctgctgtgaaaatagttttaaatgacttaactgcccacctctagtactttcttgcctgaaaggaagcaggttgtggtggaaagttggaaacggtggatgtccaggagaggacactgtggtctctgggcttctgctcagggaactagagtgaacagcagcctcctggcaaaaaaggcggcacggaagggaagccttgctctctgcagagcacacatttaatactactgccctcctcttgcagggagaggaggcaattggatgtgtcatttcttcagtttccctacgcacttagcctcttaggaaagcctcaaggaaactggaaagtctgcaggtgaatccctgctctgtcaattattaagcagtttaggagcaaatgcttcattatctgtaagatgggaaaaataaagagggctgctatgaggcagtgatgatggtgctgggggcaacacttaacatctaccaggtgcagccacaggtctgagtacttcatatgtctaagctcctttaatcctcaccacaaccccatcagggaggtgctaacattatccacattttacagatgaagaaaccaagacacagaccaagactagacaattattaatggcaaactgagtcagtgtgggtgtgaatgctacataaaatgtaaagtaccatacagatattagttaatattatctagctcaaacccctcattgaacatacgaggaaaccacttcagagatgggatgtgagagccagaatcacacagctagctaatggcaaagtcaaaacaagagccacgtccaggaagagcagaaggttttcatgtggactgaaggaaagacaaacaaaatcatttcctgttttccaggatcaaggaactggaaagagcactggattttttttttttttaaatcatcatggccctcacttagcaatgtgacagaacacggagtccaggtcctgcacttaacgtcagcccaaatgtaagatactgaagtcacagcacggcccgggtagctgagagaggcagtcacatcatctttatgagtttggagggaggcctccgtgcattcgggaaagtgatgttaactgccagcccttgcactgactctgaaattaattaccagcaaacagcctggcacaaagctaagtagatcaatatctgcgagagaaaaagaaataggcttttaactgcactgtgctttcccaggtggacagtaaatgctattgtggccagggtctccctccagttcacctggctgattgatctaagcattgttggggtcgggagcacatgaggtcatgtgcccttcctcagatttgccgagcctccaaagggctccatgcacccttccttgagggaggcttgggtaccacctgacctctcctggtgggcagaggcaccagggccaaaagatgctctcagggtgcagcagtgcgagagggcagggcttaagatgaaagcagcaagccagaaagagtggctcaaggttggccacaatcggatgggtttggggatggttaggagaggaccctttgtgaatggaagtccagctgtcctgcctccaaaacccataaacaaattggctgattgttttctgcaagcccaaaaactctctaccaaaaaattgctttcactctgattggggccagacaatgggctctatgatctactttaggaaaggctctaagattaatgggcctgggcaagaaagtggtccaatgaagaccttgcaaattatggtgacagctaacatatactgagtgcttactacgtgccaggctttgtgctaagcacatatgtctgcactggttcattaaccctcagaaaaacttgataaatagacgtgatcatcagctccaccttggacccactgctgaactctctgagactctctttgttcatacatttgaggaacaattaatgagcacctatgatgggccagacattgttgtagcaagtgacggtaccacagtgaacaaatcaataacattgctgcgcttacggaacttacaatcctgcggagaagacggtatgcagtttgtatgatagcatcaggtaacaagcgcttaaaaaaccacaacaacaaagcagggtccagggctagagagtgatgcaagtactacctgcatctgtgaaatgggattactgtgttgattaaatgagaatatacttaaaacattagcacagatcctggccatatgcctcaatacatggtacctttgttaatattctctccttccaataaatgtcagcttccttccctctaacttccccagccagcaagaaaacatacaacagaacacacacctcttccttgagctcttggccgcagcatcccatgtcaatgacttgctctggccacctctctgcccaggtaacctgctacttgctattacagaggggctgtcggttgcggcaagaatgcttggggcaggagtacaagggggatgaaaggagcacctttcttgggcaccctaagcctccagcagccccaggagccctgggaaattccaggggtcccattagcagagccccccagagaagaaatcactagcatgcccattatgctgccaggaacccttgccagggaagtattctacttggaggttggagacggggaaagggaggcctggccggtgggtgtgatttaaatacacacatcttggacaatttcttcagtgtgtgaacatcacagagtgtacttaaacaaacctagatgggacagcctactacacacctaggctgtatggtatagcctatcgctcctaggctacaagcctgtatggcacattcctgtactgtaggccactgtaacacaaatcactaggggagaggaatttttcagctctgttatagccttctgagaccaccttggtatatgtgcaccatcattgactgaaacttgttatgcagtgcatgactgtaacttcaaggagttacacaggttgaaattaggctgagtgatgatcagatcactatcggagaacctgcaagccagcccttgactgaaggtgtccattacacacaggactagagaagggggctggttcctctttcccatttgccaagcccactctcccctcatcaccaccctgcagacttgctctggcttccccggctgccctctctttcatcaccctgcttgcacctcctctttttcctccccctgttctattccacactccctttacaggcttctctgcctgcctcacccagaggccctcactgaccacttagaactgggagctccacctctctggctggcaggaaattgggtagagagagaggaggtgtatttccgttgttcagagttggagcttgaggttctccctgtagcaatatggtaatgggtggtggataattctataatgctatttatgtgatactcagttagggtggagttaagctggcttttcttttcagcaggtctgggaccctaaccccatgctgagttccaaggaactgaccgccctaaagctgcctgcctgatggtctgagagcaaagtggatcttgcataggccgggggcccaccctcgcccctttctgggccttcgtcttctcatgtgggttggagtggctcttccctaagggtccttccagcttaaacgcacattgtttctgtgactattgctaaagaaaacctgcacccaatctgtctgggacagaaccttgtgcgtgatgtaatttataatcctcttctggggagaattagcattcctgataactgccctattgattatctgatccattgtaaagacttgaagacttgttctggaaatccactgttgagcccaaccagctgtccattagcagtctttagctaaaccttctataatctggcataacaatgactaccattgtttttcctacgaaataccactactaagagtaatctttgaattagcctgctgaagaaaattttcttctagcaagattatgatcaaactttggcatatgcttgtaattaaagaaaagttttcttcagtgtcattcaggagatagtaggtggggaaactacttaaaggtttttgagcaggaagtaatttgttcagagctaagcctgagagtctaaggagatccatggggaagcagagtgcaggatgactggggtaagggacgccgaagtgaggagagcaggtagcaggctgctgtgatagtgcgagacagaagatggcggcttcaagagtggcggggccgaggccctggagaggcgggcatgcgtgaacagccacggcaaggtgaaatcagacacagaaagtgctcagaccctcgtggggtccagggtccagaggagtcagaaatggggctaagtctttaggcctggcgtctggaagaacacgatgtcaggagcacaccagggaagttaggagaaggaaatagtttagggaagttgtgggtttaattttggtcttattcattgaattcatggggaagtgtacttgggtgagctacttggggcaagaaacccctgcagcaagaaggagataggatccttagcacactgtgctgtctgaaggttctgctcactgtggcttgatgtggagagtaggtaccgcaaagaaaatatctccggtccatggtgcctcccaagccaagtgtgtccatagcagcccactctgccttttttttctttttctttccttttttttttttttttgagatggagtctcactctgtcacccaggctggagtgcagtggcacgatctcagctcactgtaacctccgcctcctgggttcaagcaattctcctgcctcagcctcccgagaagctgggattacaggcacccaccaccatgcccggctaattttttgtatttttagtagagacggggtttcaccatgttcgccaggctagtcttgaactcctgacctcaagtgatccgcccacgtcggcctcgcaaagtgctgggattacaggcgtgagccaccgcacccggcccactctacctcttataagaagaagtgctctctgagggcagtcagccaccagaggttagggatggaggtgaggaccacctcttacccatcttggtgcccccagagtacagagtgtggcacccagggagtggcctctgtgatggatctgtttagctacataaaacagaaagatggggacatgaaaacactaagtggcagaaaagatggggctctagtatctttcttccagtccctctgtgaatcatgtacttaaatattatctagtagcccagagattagcaataagttataattacagaataacaatggcagtgacactgcgaagtcagtgtgggaagatctgattgaattaaatacagaaatgacgttgccaccagagttgataagtcatacgaggaaagaagataagcatgggactcaagaaaagcagaaattgagttcttacccagtgctatcagaccctcttccctccctacaaacaaataaataaaaatagtgctggctctcatggcaaaggctaggctgcagtctttagagcaagacaggatgaataaatactagaacaatttgagtattttctatgattaatagctacaattccttttttcgttttgcgtaggtctttgaagcatcaaggttgcatataccggtaagagactgcttttatctgtcaaatctactaattgcccactccgaagaggttgcaattatgccacagtcaactccttcatgttggatctttctctgagaattcactgagatgttatgaatagactgagcttagcattttttttttttttttttttgagatggagtctcgctcagttgcccaggctggagtgcagtggcacgatctcggctcactgcaactttcgcctcccaggttgaagcgattctcctgcctcagtctcccgagtacctggggctacaggcacgtgccactacgcccggctaatttttttggatttttttttagtagagacagcgtttcactgtgttagccaggaaggtctcaatctcctgacctcctgagccatctgcctcggcctcccagagtgctggcattacaggcatgagccaccgcgcccggccaagagcttctaaggatcatgtctgagagtgagtatttctttttttttttttcttttttttgacagagtcttgctctgttgcccaggctggagtgcagtggtgggatctcggctcactgtaaactctgcctcccagattcaagcgattctcctgcctcagcctcctgagtagctgggattacaggtgtgtgccaccacgccccactaatttttgtatttttagtagagtcagggtttcaccatgttggtcaggctagtctcgaactcctgacctcatgatccacccacctcggcctcccaaagtgatgggattacaggcgtgagccaccgcacccggctgcttagcatcttcttgaccaatgagccactccagcttgatacaatggaccatttcaagaggacagaaggcaggccaggcatccccaggggaagagaggtggggttctcttgtgagcaggtcaaagtcagctcaaaccagagcaggccaaggatgcacacatccagtttcatttcaattaaggttatgtaaaagaaccttcagaagttctagtcctgccagctttgaaaaccttctctctgtaagaaccatcccttctgtgttgtttatttccttgagaaaagatattagatattaaagagacatttcaacagatttaagtgttctcagaaaagtgagatgttattcgattaaaaagctaccttagattcatgggtgagcaataaatatttgttgatttgattttcagtcctacttttcaagaagtggaattgaggaggatgttagggaatcatttttgaaagattaaaattagcaaccacagtctcatcttctacaattatattgcagaaaaattgtttattttcctggcatacaaaggagctggctttcctcagctttattttcctctagcgtctgatctacttggtgaaaaatggagaggacaaaggaataacaccaaatacaaagaatattcttggcttaaaaaagaaaaccagaataaacagagagactgctaatgtctctactcttggtaaacagcttatgagaaggctttggaggcaaaacatctccctgccctcactccggcacgtagtttcaatccagtgaaacctcagtaaattgcttcaggaaaatagatgcaagtggatttgcatttaggtgtttcaataacttgaataatttcctcaatactgagcatgacttttgcacccattattagagggggctgaaagagagtggccaagtggcagggttcccggcaggccttactgtgataacagccttcaatcactgccatcgtgatgtgacaaatcatggctttttttggtgcagctgatagctcagggccatgatgtatcaagtacaaacacttgaatgtcaacaacataagaatatttgcccgtaccagttccttttaatgtctgttaaggctctttacagaatccaataaatgtaatcaaagaccaaacaatcaaacaccataaataattctgctgagaaactggagaggccttggccgctgcacactctcccactgccttccccaagagctcgctcgcagctccctctgtcattctctctctctctctttttgttcttccttcctgccgttgtctctatttctaacacatttttgctgctgtgcaacattaatcactgaatattttctctagctttcaaaaacccaaatcaaaatttggttgctcatgggtcccttaacctacttcagtcctaaatgaaaaagactatggaggccgagacacgggcacagggttttaattctgtctcgtctcagaaagaggacagtcttgcaggaaatcatcttactgaccttccttcaggctgtagttctaaagaattttccataaaagctgtccttgaataaacagctcctgccttgcccatttggcctgctgttattctggaaggcttgtatctgtctattctaaatgggtcttttcatctcagacaattcagtggggtgtccaactttcagcagctaaatggtctacccattcctgcatattttcagattttcatcttccataaccacttccataatggttcaagtgagaaacattacccggaaaacccaaaagggaaaaattggatgatgatgttttgatgaacaattttatttagggatgtgggctctactagaatgattctttttttttttttttgagatggagtcttgctctgtcgcccaggctggagtgcagtggcgcgatctcggttcactgcaacctccgcttcctgggttcaagtgattctcctgcctcagcctcctgagtagctgggattacaggtgactgccaccacacccagctaatttttgtatttttagtagagacggggtttcacatgttggccaggatggtctcgatctcttgacctcatgctccgcccgcctcggcctcccaaagtgctgggattacaggcgtgagccgccgctcccagcatagaatgattctttaaatgattttttttaaaggattagacttaggtacattttcaatatacttttatagttttaggtatattttcaatatagttttgcccttcctaatgagaatcctgaaaatatttgagcataaacaaaaaacattgcctcataccgtgatttatttggtatcatcaggcaaaggggcaggttataccattgtaggctattaattaaattaccaggaaaattatttggctgcctgaaccatgcacagtgatcgaacagaagacaggaacccggcgtatgaaggtgctgtttccattttgtgtctggggttccctcaaacacaccctttaaaagcctggtgcaaacccatacgacatgaccatttgcttccttccttccttcttttttttttttttttgagatggaatctctctctgtcacccaggctggagtgcagtagtgcgatctcggctcactgcaacctccgcctcccaggttcaagcaattctcttgcctcagcctcctgagtagctgggactacaggtgtgtgccaccatgcccagctaattttctgtatttttagtagagatggggtttcaacgtattagccaggatggtcttgatctcctgaccttgtgatcgaccctcctcagcctcctaaagtgttgggattacaggcgtgagccactgcacccgttggaccatttgctttctgattggcttccactgtggccttaagtcccccataagacatggctgtgtggcatcttacccgcttggtgagctgagtgtccatcatgaagttatgaacgtgcttctccgctttggtgagttccagctttcgggccaccacggccaccacaagggcagtgcagcctgcaccctgcggggggacatcaagaggaccagaggggaaagaacatatcattaagaggcaagatgagagactcaacacgcctggcggccacgggggtaatttcctgggagtggagtgggaacttgagctctctggctggtcacgaccaagccacaaaaatctgttgaaatctgtcaggactctgatgtcctgacccacagaggggtctgcagtgcctcttgggttgtgctctgcagctgacctctgggaggctgagctagccagtttcaatggagaaggatgctgggtggcgccgaggctttggggggtttaaccaacaactaagcacctggtcagctgccaagctgtgcagcggaagacagaggggccagcacacacgggccctctctccctcaggcaggtctccatcccactgccagctctagaccagcaggcctgggaggaaagaaggtaggccatcagctggggtgcagatggaacacctgccagtggctgagagtgttcctgaaaataatcgaatgaagaggcaatacctttccccagggcttgtttcacagagggcacccaggttggcacgaacacgtgcactcagtgactgtgcctgctctacacttgggctttttcacctcaaggtttacgctatgactcagcacaaggaatcggttccttcctgccttcaccaggaggctcatgaattcaccgtcatgcagagattttaaagacaacaccacttctgctggatcaaaaccgggattttaagtgagcccgcagcagacccttgggattttctggaacagcgatcctagtctgctcggtaggtccgtgccaggggagcccgggggagggtgggcaaggaagcaggctctgctgagcccccagaatggtgggactcactttctctctcctaatcctctgggtgcatacttgactgtctgggaaataagcagggaattccctgcacattccaacattctcccaatgcattttaaaatcctcttcgctaggcttcttggttggcttgtgagcatagggggaattcagagactcactactcccctggctcttcggcaggcagcgggagtcagctccatccttctgcaagcggactcccgtcagagaccatcgccctctgcctgcatgctgtgccctgcgccgccctgaccaccactcatggaaagagatgatgaacttattaaagccaacaaccgaatcctgtatgtcaaacagtaattctagttgccacagaacccagtctagcagttgaggtcccagaatggaaggaatctgtcagtaacatttttggctcatcaggtcttacaaaatgtgtgagaagcagaaaagaatgtttttcaaaggtactataatctataaccgacttggaaggaatgcatatgggtggatccattccctactctctcttttagaagctatttctctctttatcccacaggctgacaaaggctagcctgtgtgaagtttcaatgtggttgaagttcacaatgctttctcctcgtttcccacaagggtccccattaaaacaatctagtgtttctcagtacatttgttggccttgtcacaaagtgaaaagaaccaagtctgtgtgaactttccttttctgacctcattttcctcttttgttcgaggacggctgtgttttttcagcttctgtgacttacaggagactctgtgcccaattttcaaaggatctgggcagttgcacagcctggtctgtagctgtaatcaatttagccatgcctccaaaagcaaaaaatagcttaaaagaagccatcctagagggaagatgtgtgctcccttcccctcgaccggacggagtatcatccctctcctttatatggagttccaaaagtactttgggctgaaagcccaaaaagagggctatatcatagcgttaaaaatggaacatcagatggagagggttctccccaggttccattctccctcctctcgctaggcccaggcaaaactctacttaaatcatccctgaaagctggggtccaataggcctgaagagggagcttccctgttccatgctattttgggaatgtaatcacaacaatcaatcatccaccattccaaatttccagggtctagatggggtgtttcacagcgcttgccatggcccacattttagctggctgattgcagggggggcttttaatgagaagctagagtgttttatctaatgaaccacctgtctcacatgatgaagataaatttctctctggaggcaggacagtggactagatgacacttcccagtttctttcaacatagagatgttatgactcccttgtgagtattcctctagaggatgctgcattcttaacccttaattccaacttaaatggatgctctcagcttcatttttccattgactggatgtaattagggcagtcaccagtaatgacacctaacctggtcttttccattaagaggcaacctaataaagatggggccagacatcagcagccttcataaagtggtggaggaatcctgaagcctagactgctgagcctctgcagactgtgcggggtgcggggcgggaaaatgaagaagggagagaagacaatagaacaggaggggaggggaggagagaggagaaaagagaagagaagaggagaaaagagaagagaagagaagagaaggtgggtgcagggagaggtaaagctgggcagaaaatgagatggggaacaagttgcgttgcatcctaaacagcaagggtcaaggggggaaagagagaaggaggaggctgaagaataagaaaaaatgatgggctgatgggattgagagaggaaggaagaacaaggagcctaaggcttgagccagaagtcaatggtccattttggccctttagaggacatgaaggaagtgccaagggatcccaccctgctgtgtccatcttcaagtggtataaggattgcctgtcccctgggtcccctttgggatgctgggccctttcacttaggtgagttaatagtctgacaggccacagtggcagcctggcagtgctgtgtcacatggcagtgatgcaggttagttttaagagacaaatcaccgagggcctggctaactgtggaatctttgaaatggctggtgggtagagggggtgtgtgaggagggaggaagcaggatgggaaagggtaaacagctgctgctatgacttccctggggtcagactggggggaagagccatgactcagccttttgctttcagatatgccaagtcctgaaccacaggggacatcaactggagtccctggatgtgctctgtccaacttccagttccatggggcgaggggagtggatggggtccacttctgatgagctggaacttcccaaggcacgtgggcgagagggagcaccgagtgcatggagagagggtggctgggacggggtgaacacgcctaactctagagattcggacccaaatctggaccgagactcctccacaccagtcctcccacctcttgttttcaagaaacattttccagctggaaaaccttagaagctggaaaaacaagtatcccaaggggaaaagtatgaggtgttcttaactaaagaagcataaaataaaataaaacacaaatgaaagtgacaaatggaggagggaagcctggaggatttacagttggattctgtttctgcaacagattccatgcaacaactaaaataacatcaattggtttgaaaccaaggtgtttcgggagaagctcatcttctaaaactgacattaagcagatgtcttgctgagccctctttttgcctcctcccgaaatgactcaatttgtgctaccttttacttcatcatcactttcccttggcagttcagaggcatctctcatgaggccattggggaaaagctcagcgtccctgcagatatccagaagcttttgcctgtttgtccataactgatgaagggtctacagagagagtccagctttagaaagaggctagattgaaacaaagttatgccaagcagccttgggggctttggggtcttccagatgcctacagaatcagaaggtcagcattgcacatcttttaggttgcactgtcatttccaattctggatactaaatattgacagctttctctctactgtgttgtcaccatgatcatgaaaaatccttatggaaagatgctggactttaatgtagctgcttttgtgggtgaaatctctcaaacacaccaggtctgtgccagccatggcaagttgttcagacaattatataccctgcttaatggttgataattacattgttactgggattgccaagagaaaacaatgattaagactatttacaggccacacacacacaaatccttcctttcccttcccaagcaggccttgccttggccttcctggtgtccatggtaaccaaacaggaagccctacctttagtaaaggcacttgcaataataattgggagctatacatagtgttgggaggttgggaggaggaggggaaaggatcctcagcaaagtgaaaccctggctaggagtgactcagctagaaaaatcacatttgttagaaaaatgccaccagggttcctcactgtggctgaccccagagtgaggcgactgactttaatttgggtgaaaaacactgacaataaatagaggaaacctccctgttcctgtatatagaaaggtgtatatttatgcacagggttttgtacaaaaagagatgaaaggcctgggctgtatttttcatatggaaggtgggaattggctcctcatcgtccgtttcttctttccactttgatcacacctcaatccacagggaacagaacgctctctctgggggagcactgcacacccagacagcaaaagggggtgctgaaagacaaacagcctccggaccccaaagagaggcaggggtggggccagggtctcgcctgttccgctcagctgtgccagagtagagccaggagatgcggagtccaggaaccaggaagccaggtctttggggtgctgcttcttggatggggacagctatgtgctgagaggggaaaaggtcggtattttaaaataacagaggctcccggcagggcccatccacctactggcaaccctgctctgtgccagccctggctgagagctggttctgaggcacaaagccccaggagtgactctaagaaggaaagatttggccttcagtggcatttcattcctttctggtaagaagcgtctttccccggtttcctcgtgacagttggtgctatgccaagacagactcctactaaccgatgggaggtatttgttctaaagccttgcacttacccgtgatttatcacaaccccagcgctaagctttttgtcattagctgctgtcgtaggacctgcctgctaatagggacctgccctggactggagtcagaaaggaggagagagcctggcccctcctgctcagcaggctgactgccccaagcctgggtctgaccgtctggtccaccaatatcagccccaggaagccaacaagacggagtggggtggggagtgggggcagcccccagccgctgtgaggcgttcactcagaccctgcaggaagacctgcggccctccctttgcactgcagaaaggggtcactgcccttccagaaagagggtcttcatctcttctggaggcaacgggggtgacaaatggaatctgagggatcactgcaaggaaggattttcacaaaggtgtgaggggggctgtggacggggggctgtccttgggagggttgcggtctccagccatggagacccagagccacaccacaagcagcctgaccacttctcaccccgccacctcccccaacactacccaggcttagatgtgctttcctctttcagcctcagtttcctcctctgaaaaaagtgtccaaccctggtctgacactgttctaggattccaggacgaaggccaaagagcagcagctgcctgtcctggacccaaagtgcaatgaggcccagggaacacttcaccaatttgcaactgaaggacactgaggacaccaccaacactgacctgtgtgtggccgcttctcgttttcaaagcactttaacataaatcattgcatttggtccttgcacaaaccaatggggagggcagggcaggccctccatctccactttcccctggaggatgctcaggtccaatatgcagagtgcctggcccagggtccacagtgagcagaaactcagaccccacatccctctcataagccacactgtgatggccatgtgacaggtgagagtgtgtgcctccgcgagagtgtcgagtgtgggtggtagggcactgggcaggagagatacaccttgaaagggcacggcacacctgctgggcacctggagatgggatcacagccttgccaaatgccagtgctgcaaagcacttggcactcagagcccagcccctccataggcagaggtggaagcagaagcctgggaaaggcaagagccagcccagggccatgtggacagccccgtccaggactcaggtcccaaaggccgactcagtgctctttccccagtccctgcttctgtgagttccagctaaacatgatcagaaatggtgccaaggtcagtgggaccaaggcaacaggaaggaggacaataaactgcaagctccagtgctcactggaggtgagcaaactgggtggctgcacagcagtggggtgggcatcagagcattgggccaggaccagcttcacccagcccattttgagggagctgtgaatagaccattaactgccaggagtccaggtctcattcttaccttagaaaagttaactgaaaagtgagaaaccattgcagatttcccacctgacattttatgtgtaggggacacacatgcaggtcggttaactaacagccaccccccgctctgcggctaggaaggcccctatgtgcttgcaagaaagagttcagctctttgccacattttaagggtagggaatggggagaggcgggtactcaccatgatgccagtgaggagacagacacctttcccacagtatgtgtggggcaccatgtccccataaccaatggaaaggaatgtgatggagatgagccacatggcacccagaaagttactagttacgtcctgctggtcatggtacctgccaatgggaagacaggagttagtcgatgaacagccattcctgggagtaagggctgtgggcaaacctagagcggggaaggaaatgagatattttgctgaggaagaggcagcagtgacggtggctcacacagatctctttaggctactgaaggggctgcaactgtgcccacccaggtcccacctgcagccccccgtcccgttggcctcccgccatgagcttggtcccagagataaaatgttttgtcatgatttgcacctcattgtagacatccttttagtgttggtaagatagctttggatgaaatcatgcagtaataaaattcaaattttcccttccaagccgacagtctaaatgtatgtggatgtgattaatctgaaatcacaagctcctgaacagggaaaatgtcaaaaaaaaattaccaaacatattcagcgatttcctctaagaaagttgaagcatctcaaagactggcatctcccgggggtctggagggaagctgtggtggttggggctctcgtggagctgtctctagagggggctctggggtgtccacagaggcctccctttctgagtcagacaggggcttgtagctgccccgccctgggaggaaccaactggaaacatcagcaccatttcctctgcccggatgcctattccaccccatccccttcctccctcccttcatccccaacaccaagacctgctgcatgccaggctctgtgccaagtactgaaatacagagatgaataccacacagcccctgccctcagggacccagcccaagagaggggtttgccaaggaggcagacatctgcagaggggtgcaatcagggggtggacaaggtgccctggggatggaggcagagggcaatgaccttgacccaaacacatgagggtccacagaggtgccacagaggagcaaggcttgcattttccaggcaggcccagaggaacgggtgctctgggcagagaaccctaatgaaagcccagggcttatacaaagtgcagcaagggagctggttgcaggctgggtggcagggctggtgaaggtgagtcctcttccaaaccgttctctaatgggatcagcctgaacaacacacaatagactctgtattttatactgtagggcttcacctcttgataaaatctcctcttaaccacttggaggccactggatggggaaagctaagaacaaagggccagggagaccaaacctactaggctggatagagcagaaaagccatttaggaaccttaatctatggaagtcagttaccattggggcttccgtgagttaatgcacacaacgtgccgggacaggcctagtacaaggaagccccctggaaggattcgctgccgtcatcaggaatctccatgcccccacagggtctgtgcccagcgagtgataggcaaatgctgcttttccttcccttggcgccttaagtgaggcgtgcagggcaggctgcatgtgtagatgcatctagagatgggcctggaaggagacaggagctcagccagtcagaaagggacagggccatcaagtcagggagcagcaagagcatggtatgacggatactgtgcatgtattgagcacctactgtgtggctggcactttgtacgcaaacattctcatctcacaacagtctttaaagtatttcccaggtaagcagcaggaggcacggagacactgggtgacttgcctaaggacacacaggaagcaaagcccatgctcctttcactgtttcactcaacatcagagaggcaaaagcgactggcgtgtgtcttgggaataatgaggaagcttcagtgagaggagagcacctgggctccagtagcaggtgaccagggggcttcagagaccaggggtcagatttaggaaggcctggaattctgggagaagaagcttggatcttgtcttagaggccttagaagagattctgggttcttgagcacaggaatgacaagataacacagcttgctgggaagaatggtcggcgggtggcgagcagggtatctgaagagacaggacacagaggtggggtgaccaggcaagaaacaggtgtgcaaagctgggacagagacgcaggccacagcctttctcacccaccggagcccggccctagcagattcccgcgagcacatcaatggtgggctctccagccccacttgagtccttggccagcaactggagacccagtgggtggcacagcattagcctttttgtggctgtctgcacaaggacatgggtgtctggtacttctggggacatctgaagaaaagataccccctccccaaagctctgctaatgagatggccttgcctgcccactccatctgctatacttgctccccagggatgctctgttaccaccctaggggcccctggctggctgcgtgggcctcatttccctgggctgggcctgcctttgctcccctggctatccttgagtagcacaggctggtggctcccaactctgattcccaggattgcgtctacccctgaccgtgacccagcgcatcagccccctcccagttctgctgtggccttggaaaggcagctgtctccctggcctgctcactctgccctgctaggccctcaggtcaatgcaacccctcccttcccagcaggttgctttctggctggagggatggtggcagaccctatcctcaggccctgtgctgaggcagtggtggaaaatcagactttagcttctctaaagcagcaagactcagtgactgtgggaggggacacagaagggagaagacgtaaaggcagctccacgccacaagcctgcaacacataaatgtaatacagtcacagccagggtcctcagttcttccgaaaaacatttcctggaagataagtcttgggtaaggtctgaagaaatgtggttgaggcagtttagcagtgaggagttgagctgagccagtgatcttgggctgggctgggcttgcctggcttggagctccagctccagagttaagtagctccatggctgtgggcaagtgacgtgccctctctgtcaatcaatttccttatccaatgatgggaggattaagtaaaataacccacaagcaataccagcacagtgacccaaattaagtgctcactaaatgtcagccattattgttgctgagagggcgcaggtgttatcagtctgagaaacaatagacagaaaaatacaggggcatggatttacacgtgcagtggagtggtgaggcattcatgaagatgtcttgaagtttaggctggagaactatttgatacagacacaaaagaaatcaactgtaagttcttggacaaagaaaagacatgagatacttagtatctgaaaatgattcttctacatgaaagactgactaaaggggtcaggccccagataagcagtgctgctagaagctttgcaggtgtccagggagaagcaatggagagccttgaataccgaaccatgaagttaggattaatttgtagcctgccctctgtgcacatcatggattttcttgtgcacgtgggtctccacagtcctcctttccctgcaaaccctgaggattaaactcgtgctccctggctgtttggctgcccttaggatcatggaccatcctattcatatgtgggaggatgccaaggtaaagagattagagatcaaagtggaattacatataaattatgttcttgtgggtttcttttttcattcaccataataaactcctgtgcgtgctaactgtgtgtgctgaggagaggagtgaagatcttgagagtgtccttcgttgtttgtcagccttcagtgatcgcttctctggtgggggctacggaagatgctgagatgaattggacatgcaccctgctctccagtggcttggagcttcgtcatggagataagacatacatgcaactcaccaagcaggaagtgatgagccagaaggctgggctggtgattcaggactgtgggagtagagaggagggagaaaaggtttctaaacctattcacaattttagagcggtttacacatgtcacaaactcacatactaatcttgtgctattttttgcaatagaaaatttgggggggggggatagctccatgtttttctttaaaggctgaggaggaaaagatgtaatttttctttgagctcaagggtagttattacagttactgatttatctttcagggtgtggactatggattttttttcacttcttaacatgaaataaatgagagatacaaaagactgtatgacttggcaaagatggtagagacatatgtctacttttgctcactcaaatcccttacagctcaaagttgttagtctcctacttttaaaaataagcaggcaaccaggaatccccagacagtcaggagtctctaacatgaaagacacagatcaaaccagtcaactaaacaaacaaaaagaaggaactctggatcaaatacagaccattcacagagagaactcttgaaggaaaaatcctataattaacgtaagagagagaaaataagatactggacccacgagacaagaatggaatgctgtatgaaaaaagtcttcctagaggggctggaagatgataaatcgaggaattctcccaaaaagcagaaaaagacaaagaatgaaaatgaaagaaaatatgaagttaggcattgtggtgtgtgcctgtatcccccagctgctcggaggctgaggcaggaggattgctcgtgcccaggaggttgaggctgcagtgagctatgattgtgcccctgcacttcagcctggggacagagcaagacccccatcatctcttaaaaggagagagagggaaagaaaatatgagaaaattagtgaatcagtctcccaattcaaacagtagaagttacagaaagaaacaactggggggaaaagaaggagaaagaaggagagaagtaattattttaaaaatcattcaaaaacaaaaatccccagaacttaagggcatgagtttctagatcaaaggctcactgtccccagcacagtggatgaaaatagatgcacaccaaggcacattattgtgaaatttcagaacaccaggggaaaggagacaatcctacagagctttaggggttttgggggagggtataaaagaggccaaatacaaagaaccagaaattacaacagcttcggactttttgacagcaacactggaagctagaaggccatggaataaagccttcaaaattctggaggaaaattatttccaaatcagaattccaaaccagagaccagaaatctgaattggccaaagtattagttcagtctgagggtggaacgaagacattttcagatacgtaaggttgtcacgggtttgcctcccatgcaccctctctcaggaagacacaggaggtatgcttcaccaaaacaaagaagtaaaccaaggaggaagacaaggaataaaggtaacgagctcagggtgatgctacagggaggccctcataggacaggtgctcaccaggtgcggaggacaacccgtccgggctggagcaggtcaagaggctctgggagacacttccaaggagatgaaattgataggaaacttaatgtgcctgaacatcctgaaaagaggtttagacaactgccagagtttgcacttgcattaatgacgaatacatagaaaactaagcaaacaaacaaacacgatcattaacaactccaggaaaaatgaaaagttctgcaggaagggaaaagttatcatattttttactacaaggctcaactatgaatagagtcaaattagtgttgactgagtaatgtaaacactgattactgctttaaccaaaattatgatgtaattataaaaggaagatgaagggagaggaagagttggaggagaggaaagggagctaaattttcatctcccagagtgggaagggaatagataatacctaaataaaccaaagcatcaaaaggtagcaatacacacatattacttacagacatggaggtaaatactaaaattaattagcaaaagaaggtaaaagtagctgcctctggagaacagtaaatgggaagagctggtggaagacagcaaataccacggaaggattgactctacagtgtatgcacatgtaactttgatcatatcaacagaacaccaaaccaaagagaaaaaacaaaactacatgcaacattaaatgacatcaagaaacacagaaagaaaataagcaccatgaactcaccatccagctccaacctgtgggatctacttgtatgttctctccattcttagtgccccccaccccaggatcatcattaccctgaatgtcatgtttatcatttcctcgtttttcttcatagtgcttccatgtaggcaggattacctaagcaatatgtaatttcatttttcctatttccgaccttcataaggatgaaatcataccacaagagtatggtaggaagcttctaaaatgacctcgatatcccccctcctcttgaggtcttcacacacttttgcaatcctttccttttgagtgtgggctggaccaagtaactggtttctaacacatagagtatggcagaagtgatagactttcatttctgaagttaggttatggtaagatcatggcttctgtcttgggtgatctctcactagttatcttttggatcactctccctgggagaatccacaggccatgtcgggaggcaagcccgtggagtgccacatggcaagggacacagcctgccaaccaccacatgagtagcttagaagcaggtgttctttaagtcaagccttgaggtgagaccacagccctggctgacagcctgacaatctcatgagagaacttgaggcagaggtacccatttaagctgcacctgaattcctgacccacagcaaccctgagatggtaaatgtctgctgtttttagctgctaaattttggagcaagttgttatgtagcaacagataactaatacagtgaactcttctatgaattgcttcttttctgttcaacatatatattatattgacatatgtagctatagtctatttttattcctgtattgtatttcatcatatgaatatggcatgatttatttattcattcacctgttgatggacagtgggatagcttacgggtttttcctctaatgagaaatactgctacaaacattattttttattgacttattgttattgtatttttagagacagggtcttactctgttgcccaggctggactgcagtggcacaatcatagcttactgtagcctcaaactcctgggctcaagagattctcctgccttgacctcctgaaatgttgggattacaggcatgagccacctcacccagcccaaacattcttaatcatagctcctggtacactgcataagagtttctctaggacacatacctaagactgggtttgctggtttgtaggatatgtacatatttcacttcattaggaaatgtcaagttgttttctaagatgccagtgccaattaggcttccaccagaggtggataagagttcctgtttctccatatcctcattaacacttgccattgtctgactttaatctctgccacactagtgggtgaattgggatctcatcaagacttgactttacgtttccatgataaaagcttaagtagcctttcatatgtttctttgtcattcatactttctcttctgtggcgtgtcattcatgacttttgtccacttttctattggcttgtttttgttttttctcattgattctaaaagttatttatatattctagataataagaattttgtcagtttgtgtgttgcaaatatcttcttccagtgtgtgccttgcctttttctctacagtatttttgatgaatagaagttttaaattttactgtaggtgactttatcatcctttaatttataattagcagttatttggtttttgcagaaatcattccctccctgagattgtaacatttttacatattttaaaatgttgcctttctaagtcttcaatttgcctggaattgattttgcatatggtgtgaggcagggatacaacttcatttttttcacatgggtaagcaattatctcagtttcacttaatgtgcagaccatcctttctcctactagctttcaatgctccctctgtctcataaattatatgtggaagtggtactatttcttggttctctattctgttccattggtctatttgtctaaccctgaagttatattacagtattctctgtagcctttccttggtaccttctgagggtctagcacataataggggctcactaaaatacttgtggactgactaaggcctgcatgctgcttttcctgtccctctacaaaagtgaggcttgcttcagtaattcagtgaatcatgttaaaatgatttcagctgttctcttcagcagattaaacctttgtcaaggtggctgccaaattccttgagcttggagtcagttctcactattaataagaactcagcttcatgacactagctgtgatctgttacagcactagggtgacagaaaataagccaaagtgaaatgactgcctcttcttccttattctccaaaagaatttgaatactttttaaaactagttttgtaaaaaaaaaaaaaaaaggattcttttcacatggatctacatgatatgacggctctagccatttgtcctgggtctgatttgtttgttggaaatttgcaggcattgagccagatcctctgcagaactccaaagcagccaaatggactgcttcgtccttgccttccggtcaatcttcagagtcacacagtcagacctgcccactgagctgtgaaccctgtgcttgcgaatttctccaatgaggaagccaacaacacgtacctggcttggccccctggcggcctctgaccccaccggtgcctctctcctcggaacactgccctcctctggcatctgcagcggctcactggcctgctttcctcccgccttcgactgtgcctccttggcttcatgctctgaccaccgcttcagggttgctgtgctccaagcttgccttgcacacatggctctcttgctcctgtcactcctgccctgtcctccctgatgccttctaactggcccttcaggacccacttcaaatcccatcctgacccacccagccaaccccagctctttgcctgtgtctcccacacgtggcatcagcaccatccacctactgcccacacactggcttgcagaaaggccgcaaagctggctggggtatagctgaacctacaggttccagggccagaacacctatgtttgaatccgggctttgcaccttaatgtctgcatgaacttatcctcagtcttcccacctgtaaaagaggataatacttgtaccacctcacagagagttactgtgagggttaaaggagctgatatgtctaaaatgattagagcagtgccgggcacataggtgcactaaaaaaaagtgctattttcatctcgtgtgtctatggttagccttggcatagcagaaagaacacaagatctggagcccagagactgcctttcatgccaaatggctctgtgaccttgagcagatcactccacggactcagggcctgctgcttcttcggggaagcagggtgtaatgatgccgtcctgcctgcctcgcgaggccgcggtgaggagtgaatgtgcacgggctccatcagccttcagcaagtgatacagatagaggtatgtcacagcctctgcaggagcctctcacctggggcttcgtcctagtgacaagggcagctgcacggatgtggagaaagaacaggcagcagatgctgctgtgtaggaaaacagaaactcctcccagcttctccttttaatcttcgctgttcttctgggtggctgcagccccttctcttcatttggtgacttgcagcttaaaccccttatctccatcaaattctgtcacctctgctttcaaaatatctccagaatcggagcgcctgtcatccctggtctgtggccaccctggaccagccccaccctctcaccttgtccagccccaccctctcacctggaccagccccatcctctcacctggaccagccccactctcttacctgctccagtcccatcctcttacctgctccagccccaccctctcacctggatcagcaccgccctctcacctggaccactgcagtagttgcctcactggcctccctgcttctgcctgggcgacgcttgcctcaggctagtcctgttacagtagtcagagaggccctctaaaaaaagtaagacaaaagttcctgtatccctcagaaaaaaagccgaagtcccctggggcccccaacctgggggcctctctgagcccatctcaccttcgcccattggccctgccacctggggtttctgcagctccttcacccagccagctttactcctgcctcagagcccctcacctgctgttcttttcagagatggccctgacttacaatggtgccactttacaatggtgcaaaagcaatacacagtcggtggaaagcgtacttcaaattctgaatgttgatcttttcctagggatctgtgatgcaattctctctcctgatgctgggcagctcgcagttaaccaggtgatcatgagtactctacaaggtcctctacagggcactgtgctgccgggtgattttgctcagcggcaggctgacataagtgttcccagcacgtttaaggtaggctgggctaagctatgatgctcagtaggttaggtacgttcagtgcattttcaacttatgatattttccacttactgtgggtttattgtgaagtaatcccatcataagtcacgggacatctctacttagaaggctcttatcccagataatttcaggcctttgcacaaatgtcagcttctcagtaaggtgttacccgcccaccctgtctccaagtgcactactgccccacacccagcaggccagcttctcccgagtcattcttctccacagcgcttatcaccacctgacataatagatatgtggcctatttttgtatttattgactgacaacccctattacaatataaggttcatggaggaaaggactttttctgttttctttactgctgtatccctagtactcaataaatacttgtccaatgaatgaatgaatgaatgaatggctccacttcgtctttctcacaagccagtgggacaagaccagcaggataagagctgttacctgattttacagtgaatcagtgcaaagctccagtgcgtaactgacctaactaacttctcacagcaactaagcgaaaagactgggactgaaacctgtattttttcggctgctaaagatggcaattgtagtgagctgggcacagggtggggcgtggaggcagcacccgtgtgcctgggcaggaaccattctagcttggcaaaatacccgctcagccactgccagtaggtgatggccgggaggctctgtatgtgactggcattcgaagctattagaagcctgaattagaagctattatgaaaggaaagagactttcatggagtcctgggttttattcccattcccagctctgcctttgtccaggtccccaatataatcaacttctaattatcaagtaccttcagcatgctagggcatgtgattccagctttatggagaaaatggggtgaaatcatcatttcttaagggtattatgagttcctttagtttaggagcatttcagaaatgcttgaggcgtgtgaaagaatcccattgaaattcaaaggcagctgaggaataaatggcctagggtgacttcagggctattactgcttgtgccagtgggtgaattcacattaaggcaaaaaaaaaaaaaaaatagttcgttcttttctcaaaaacaatttcccttataaacatcttaaaatgtaaaataaatggctttgaagactcagggctgatcacaagcctatcaaaccacgtgcccaggacaccacatgcatgtataaagccacccctccatccacttcacctctgtgtcctatttttcaagagttggctttgaatttaggaaaataacgacgttttcctctaccaggtaattcaaggtaacagccctggatctttccaaggcaactctaaatctagtcttttatttccagccctaagaactaacagcatggtgcaaggcctccagttatttttaaaaggagagaaaaccagcaccaccagagcacaatggctccaacaaacaaatgcgacttgccgccaaacaaccacagcttgttcttgctctgtgaaaacgagagtttggttggtgtggctttttctcaccgaggtggtggcatctctgtctccattagtggtttcctgtagaagcttctgagaaactctggaagaggtgggacagctggctggtgtcacacagctggatgcaacctctgcaggcctcagcggggaagcttcaacaccagcactggccaagcttttcttggagtgtgtttctcttctcttgggtctcttggtcttgctcaacttctccaccttgcaaatggatgcaccatttgagggaagccagctgccattccttccacagtccattttcttcttagagggaagcactgtcaacctctttgaaattaaaaaccagatggctcatctggcaaatccttctgagtcagtttctcaatttgcaatgttttctttcttcttattaaaaaaatatttccatgtttcctgatttggaaatgtttaataaaatgcatgaaaatggagaaaaataatatgcttggaagaagcactgttcccatgggaagcatgtcttccacggtatctggagatggcgtggcagagatggcatgggcagagagtccaacagacgggggtttggatcccagccctgccacctgttagctgtgtggcctagggaaggcgcttacctctctgtgtcttgggcttcacttctgtaaaatgaagcagtaaaaccttgcacgggactagtgaaaaatataaaactctgcatagtgcctgacacaaattttggaacttagtaaatgagttcatttggtcagcaataggaatgagccccctcctgtgtgcctggcttggtgcctacttgggaacttagagttctaggaagaaggcagacaccaagcaacaccaaggcaaaaaagggccgcgttacaatggagacaagtgatgccaagttggggcacggggccactgcgcaggggacacacggctatctcagaggagcaggtatgggttgggatgacagtgctgcgggtggagtggcaggctcaggagaaggctgaggtgagttggagggagaagcagggcggggaaagaactctgagcatcttctcaaagttgccagtgctggggtttaataagcagaaccccgtgaactcacaggcacagctggcctgcactgttactcttgccccaaacccctccatcttcttcctccttctcctctatttttcctgcctttgcccctctctgttctttcttcttctctttcatgcttctttttctttttttctcctttgaagcactgtctccacctccctctcatctctcctctcttgttttccctttcacttgttcagtctctctcccaccctcccctgtgaggacccacagaggaagctctgccctagagggaaagggtttctgcctccaaggagctggctatcccttggggacatcagtctttgtttgcttcaggttgattttgcttaatcagcaaacttgcattttgcacccactgggtggccagatacagatggcatcaaatgtcaccaggcagaatcctgtgctgtaaagtggggagggtaacatctggagtaggtgcatgggtccccccaacgtgggacatctctggaggggtggcaggtaaactaagctcaaccgatccccaactctgctcattacctgccctctccctgctgcccaggtcccctgcaaccccggccctcttcctcctgcacctcctattcgtgggcagtcccaccagctatccagccagccacactaggacaccagacactgttcctgagcttcctccccatcactccacatccagtgagtcagtccggtggaggttggctcctctagctctctcaaaactgcccttgctcttcatcccagccaccactgtacccaggggtggtgggggcagcattctgttactacagcagcctccccagctggtgtcccgtcttcccctcaaatcccccttccacactgcagccagggaaatctttctgaaactccagaccctcccctgctcccaatctaccagtggctccccctctcctaggtgtgggaagaggagaggggacgttctcagcctctgcacagcgacacactggggcagacaaacagtctctctggggctaatagtagttgaaggattgacatttgtgaacgatttattttttttgttatggcagtttcaaggctatcctgtgataatatcactctcgctatctggtactctgatttgctttcttcagtggaaaggaagggccgggactccagctagcctgatggaaatgatttataacctggggcacacccacagcagaagtcggctgtctgaatatcatctctcctgcatcgctggaatcaaagaaacaagtacataaataaggttggaaactgttggctgatagaagagtcattccaaaatccttaggctggtgaaaaaggcccgtgcctgctcctgtagcgttgagtgcactgccgcatcttatgacaccccagcaagcaactgcttattctctcctccaatccatgctcccccacctccgagcttccctcatgctggcccctctgcccggaggccccttaggcctaggaaatcacctcctccggaaagccgtcccggatcaagtgccctctgtggagccccttcttccccattctccctcacttctcaccaccggctcttggccatctccacccccagcaccagcctccattggttggttggtttgtcggtcggcaggtgctgagaaagctggtcagagctactgaaggaagctgtgaatgaacaaggacttaggggaaagtgacgtttaaacctggtctcatctcactccctgctgtgggcctctgctttctgtttaaagccattctgggtctctgcttgctctcacagctgctgtctgtctgtggttttcattgagctccacccgcccggggccctcagtctgccgcccgcgcctgcaagctttctctctcctggttgagcctttcccgacatctgccatcagtcacagagcgtgacttggaagcaaaggggcttcacagttcatcgttttttatatacagagagaagaacaacagtagttgggattcttgcaaaatacttcctcaaagatcttagagatgatctacttctcatttcattttatttctggggctatctctgtgtggtaggtaagactggatgctaatcttatttgaagagataacaataatcactatcatttctcaagtgccaatcacgtgccatgtgggccaaagctttatgcgcattactgaatttaatcctcaaaaaacaagactcataactgtcacttcctattttactgaattggaaaattagaccaggtgcagtggctcatgcctgtaatccaagcactttgggaggctgagacagaaggatcccttgagcccaggatttcaagaccagactgggcaacatagtgagatgctgtctctacaaaaaatgaataaaattagcagggcatggtggtacgtgtctatagtcccagctattctggaggctgaggtgggaggatcacttgattaattactagattaggaaacttgcacaaaataaaacatcaattgagtggcagggcccgagtgtgtgcttggacttgcctgcatccacagccctgtctttgaccatattgcaccttggaggagccctgtctttgaccatattacaccttggaggaggtggagacctaaaaagggaggtgagatgagtggagagactggtggggattctctctctctcaggtatctcatcctggatctgtgttataatgagccatgcttcccaggagagtaagacagagccagggctgccctgttcagcagcataggttgcgcactgtgcaactccaaggagtgccagtcacgaagacttcaatgtgaatggcaccccctggagggaagtgctgcataggcagtgctcctggcaagagccctaaagaaaagacgggtgtcttgctcttctcagttatgctttccaaagataattaaaggcaggcagctccccaggcaagcaaatgttgtggaaggcacacaaagctgcagcctcacctaggcagggttagtgtgggaaggacgtgggaatcaccctgtgaccaagaacaaagaggaacagcacagaacaagtaccctgggaaggaattttcttgtttttgtttcccagagcagtggggttcccagggcaggacgtgggagctctggttgggcgtctttccctgccacagagaagacagggtgccaaggaggagcctgggacgtcagggcgagtgggaagaattctgactcagcagaggttgcaaagtagcccccagggaatcagagagagaggaagatagagaaagagagggacagggatggagacagagacaatggctggaaggggaggagtctgagggcaagggcacctgggtgagggtctggcctgagcatgaggggcctgaggacagggatatgcacaataatgccctgacccggggtccccacggccgtggggcttggggagactacgggatgctcccggaccacaagcagcctgcccagggagtgcagctgtccctgacctctcgcctctttccataggcctgggctacgcagaaaggcacatttccctgctttctgggagtgggctctggccaagtgaagcgtcacgaagtctgggatgggagtagtttctcaggggctggtccggccccaactgcccacagccaagtcacctgagccttggtttacatgattaactgaaaattctggtacacgtcaggaataaagctaattccgaaggtcaacactatatggagaaaggaatggagacagccagtcgcacacacttttccctcagaagggcctttcttgctggagaagcttctaaagcctcgaagctggtgcaccccaagctctggagagcagcggctggaagggaaggctccaggcctggtgctcaggccaagggcctcctgcacccctcctcacccatttcctcggccccaggagcagaatgaaagagatatgaagagacagattgccttcagcaatccttttctctgcctcttgaactgagagattcttacttaaggaaaggaaggagcaggataaagagatgacccatctggagatgccttctcacctgtggggtctgaagggaatagagcaaaacccccttcgcatcaactctcacagctctgggcctccctctcttcatctgggaagggtggggggctgggtccatgtgcattagggccccttccagctctaaggagctgtaattctcagagaatgttttcttacccgtttcccacactagatggagagctggttaggtaggggagtgggcagctgcagccctgatccttgataagggtcttaagagaccatctttgaagacacagatgcccaggaggcttgccctaaatcagcctcatggtgacaagtgtcgtggctgtgctcggggtctctgcatacagtgggattctcctggggagcatcagctcagaggcccaggaccccctcagcttctgagctttcctggggcggtgagagcagccctggacacgtggctgaaggcctgggcagcaggggcctgcctgctgtgtcagctttaccatcagagtcactgagtcttggggctccctctagcccagttcacctcattctttttagataagcaaatggaggccagaaagcggagaactgggcatctggtgcacttctcaccacatgctgcctctttctagccacagggcatcagatgtgtgagctcggcagagtccagtcccaggagagagacccttggctgggagctcagacccgcccaactcgcggtgtgagtctggacaagttgcttcccttctttgggctttggtttcctcgtgtgtacaatatgaggatttggctaaagaagctctaaagccccctccagctctaagtcaggtgtttttttggatcacattctgtcccccttctctctcccactcccattctcgggacaactagcagctgggctgactgcagaggcaaaagccaggtgtctttccagacaggaggcctgtggcatcccgtgcagacaagatgaagcaagagtcagcaccagtggaaaccacctagcagccttcatccaggctggccatgcctcagggagctgcagcaggtgcctctcaagttacacagaacttctgatggctcctaacccaaggcttttcaccactggacacctggggtgcctgaaatggggcaggagagggcgtgccagtgccaaggctattataaaagagtaagaatggcaacactcagagtcaccatggaagccaacctgtctgtctgtccccctcccctgactcctccccatgaccccagagaagctcccagagactccttcgtccactgcatccccagcctggctctgttttaagggaagcagccaccacagaagatgcttgttacacgttgccaggcaacaaaaatgctgcctgaaaactaaaacccacctctgactcttcataggactggaaactggcagatgagaggagcctgccagggaacaaaggagaagcatcgagagggaaatgatggagttgagcaaccacagaaggcaaaatgaaagagcccagacagttgtgtaaagtgccagaaagcaaacagatggggaggaaaaactgactcactgaaattaggaagacagacagagagaggaggcatggaggaaagtcctccgggtgttaagtcctcgaaaggcctcctttattttttttctttttggccaaatctgtcatgagtagagatgaggctgttgataaggaagatgatgacaatgatgacgatgatgattccttaggtgaactctggtctgcttttatccagtgcgtgatttttattagatatccctcaagcaatggcacaattctccacagactttcagaaaacataattatcctctaaaacgaagatctacactgccattagcaccatcagctcacccaaatatagggacatcagcttgttagctgaagtgaccttgggctctgggatcttcaagcactgagcagatgaaggaaggaaggagtgatgttcagtctggacagccatgcccagctggcaagggaacctcggagaatgggagtgctccaggtggaggactctgcgggcagcagccccgggccagcagtgagaccctggctcgcttacctcccaaagcctccatttcctaatttctaaaatgggaaaattgctcctgccctgcttacttcacagagtgctgggccacagaggagaacctgtgtagaatgaatggccatgaacgaagatagtgctccttatttattaaaaaacaattcctagcctcctacagaggctgggcactgtagcagacattatcacacagacatgccccctgctgggggcgaggcaattaagcaactccacactatggtgggggagttaccccactgctcttggcctcagtttttccatcagggaaatggagataacaccacaaagcattcctatgaggacactgcatgtcagaagtttctcctccctcggcctgtggtcacccttgactaggctccgagcacccggctcagactcacctgcctccagttctgcatcacgtggcctcagggacaggccgggcacctcaggaatctatcctctaatttctgaaataatgaaaagcctccagacacatttactctctaaataaaatgcacagtttaaattataaacaagacaatttaagaatactggtaactaagtgggaacaatttcacatgttaaacttgacaaaataattctaaagctactactcagttaactatattcacatctacttaactcagtaagtttgacaacatagatgtttactttattaagtttgttatacattttctccaaaaaagtctagccagtcaccagaccccaccccacccctcgaaaacagacatcatggcattcaaggacaatgagccgcttctgcctgtacttactaataggcagtggcttccccctaaaaatcactgtttttctagaacaccaatcacaattcctttcctaggtaccaaacagcatgacctcaaagaaattagaaaatgactgcacagtccaagctgaaagaaaaactttgcgtcttatgttctttctccttttgtctcaacacagactcactctgtaacacacctccccagtggaacacataccccaaaagccctgccacaggcgatcggggtcccaagggcccaggcctcctccactgccctacaagtcagggccagggcagatcatgagcctccttgagccaccacatcctcatccacgaaatagggaccgtgggttccccgtcctgcctgctcacttcatagggtcgtggtgaaaaacagaagaggatgtccagtgttttatgtttcccccagctgttcaggtctcctcttgtttgaacttcctaatcccctgggaagcaggtagaccaggcttacttcctatctacagatcccaagaaagaggcccaggaaaggaaagggctcagggtttatcaggaaccagccagtcgcaggtgcttatttaatagagggcaggtgacttgcccaggatcgcacagctggtccgttgtcaagccaggctatgagcgcacgtttctgactccaggggccatgtgctgtcccttctgtgagcaataaaaccttccatgtaggaatgcaaagtatcattattaccattgttgctgatgttactaaaattgaaccaaaccggttttatcatgggttgactggaattgcatgatggagggccttggtcactaaatttaaaaatatggacttaatcttctagagggagcaattgaaggtttttgaggggtaatagtaggaacggtaactggaagccagaaaagctacttctgtaaactggtgtaagatgacagggatctgtgtcagggaggtagcaggaagagatgacttcaagcgacaccgcagaataagaaccatagagcttggtgcctaaatagagggctggaaatggggctgggagtggcataaggatggggaacgatttgagcctgagagatggttgcagcccaacagcacgtctcctcttcttcattagtaagagcgcccaggaaggagcaatgattaccaataataaagactacattttcccgccatgtgaatgaccaacggatgtaaatgaaagtgacatgtgttacttcgaggaaatgtccttaacaagaaagaaacaaccttattttgtccatttctctttcctgatggctaaaaggtaggtgggatggctggagctccagcagctttcttgaagtatgaggaagaagccacgtaccaacgatggcagggcaacaagggagaaggagcctgcgtccctgatgatgccatagagcagcatacctgctatagacacctttccggacttctttggcgtcagacagaacttctgttttgtttaagctattgttgttttgggtttcctatcacttgcagcctaaaacgaatactaacgggtaaagttcctgagaaaaagaagacacaaacagagaagcagagagagaatttaggggcaacatgatgagtttgatcacagatttgatgcgtgggacatcagtacaggagaagatgtatataaaacttggcatggtgcagggatgtattcaagaactctacaccgccaccaccgcccttctaagtcacttttgtctgttgcctggcctgctgcagtagcctttttagtcctcctagtagttttcttgccacctccaatttactcacaaagatgccaaagtaatatttttagaagcaaccatattgtattactctcctatttaaaacccttcaaaagcaccaggcatggtggctcacacctataatcctaatacttgggaacctgaagtgggagtattgcttgaggctgggagtttaagaccagcctgggcaacatagagagactctgtcgccaaaaaatttttgtatttagccaggcatggtggcttatgcctgtagtcccagctactcagagggctgaagtgggaagattgcttgagcccaggagttaaagcctgcagtgagctgtcatcatgctattgcattccagtctgggtgacaaagtgagacaagaaagaaaggaagaaaggaaggaagaaagggagaaagaaaggaagaaagaaagaaagaaagaaagaagaagaaaggaaaggaaggaaggaagaaagaaagaaagagagagagagaaagaaagaaagaagggagggagggagggggagggagggagggaaggaaggaaagaaagaaaagaaagaaagaagaaaggaaggaaggaagaaagagggagagagggagaaggagaagggagaagaagaagaggaagaggaagaaggaaaaggagaagaagaaggcaaagaagaagaaggaggaggagaggtggaggaggagagagagaggggaggaggaggaggaagaagaagaaggcaaagaagaagaaggaggaggagggggaaagaaggaagaaggaagaagaaggaagaggaagatgaggaggaagaggaggaagaagaaggaggagaagaagaagagaagaagaagaggtggaggatggggaggggaggaggaggaggggttggggaggtggaggaggaggaagagcaagaagaacaagaagccaaaggcaaagaagaagaagacgatgatgaaaaggaggaggaggaggaagaggaagaggaagaagaaggaggaggaggagggggaaagaaggaagaaggaagaagaaggaagaggaagatgaggaggaggaagaggaggaagaagaaggaggagaagaagaagagaagaagaggtggaggatggggaggggaggaggaggggttggggaggtagaggaggaggaagagcaagaagaacaagaaggcaaaggcaaagaagaagaagacgacgacgatgaaaaggaggaggaggaggaagaggaagaggaagaagaagaaaaagaagaagaggaggaggaagaagaagaaacaacaagtaaataaaaagataaaactctttaaaggctttccactgcacttaggttcaaccccacaacatggcactcagggcccttcactttcagcctcctgcccccttctgcggctcagtccctgccacaccccccttcatctgtttactctccttccagtgactccttccccccggctccttgccagctcagggccttggtgcagtcttctcattcttctcagaaggctcaccctcttggtctgtgaagggctcatttcctctcatccttcagacctcagctgaagcatcacctccccagagacacctccaagcaggccccagatgagtaggatcccaatccaatgccataaatttttttttaaaaaagaatcattgcaaacttcttttttccactttcacagtatatgtcatagatttgaaattatctactttttgtttccttacttgttacctgtcttccctggtagactgtaagcccatgagggaaaaaatcatgtgtgttttatgctttaagatatatttaattcctagcacagtgcctggtgaatagcagagctccacacctatacataacagtattattatttagcaagtctctcatgagagcactgcagctcagagagaggcgtggctcaatgctccacttgggatgcatggatgcattcctgtgagagtgcctgcattctccgggagcaagcatgatgaagggaaacggcagaggagggagaatgtccaggtaaaggacagacctgtgtaggaaatagggtatggggggaatcagtatgagatgtgtccagagagcaggagagatctcaacttcagtgctcaaacaatctgttgagaaatctgcgggagcctgagaaactaactattgcttttatcagcaggaaaactaaggcagagagaaatggacttcaggccagccctcaactcccttgctaaagctggaaacaggacaggagcctcttgtctctttgagtcctggctggttcccacgtggctgaaccactcctctggccttactgagctgtggctcttatctggtagtggccatgtggaacaagggtgcaagttgctccctgcaggattcaggctaaacaaggcccttacaattgtattgaagaaaagttaacaatagagcatggggctatagaatggaactgtcaagagtgcccaatctaaacagagatgggccctgggtctcgctccctaattcccaggccattatgcctgggagccctttgccctaagaatatgggccactctcaggctgcattaaaaggaaaataatgccgaggaaatgggaggatgcctaacacttggggcactatgttcgttctggggccttcgcttcatgaggacactgatgaccaggggaggagagtgagcgagagggtggagtctgaccagaagtcctgtgacaatggttgaggggactggagaccactgggttggagcagagaagattcaacctgactttggatactcaagggaccttcagtagaaaaagaaatacctggctgcttcactgggtactcaccgtgtgctaaatgttctacactgtgctaagggctttttgtgaattatcccctttcctggcccaacgtcacctgctagtaagagcataagcaaggctccacgctcacatcttcccagaggtcaatggcttaaccgccagcctatggtacttgaacttctttcgtgcggacccagagaactgagttaggacccaagacagaaactacacgttttaaccaatattaaccaataataggaagagatttctaagtcagagctgtctgcaaatggattggatagtcttttaaagtagtgtcccagagggtgttcaaaagaggctgcatgactctggtcaggttaagtacaagtgcaaggttaatggtagaaccaggggtcaaaccgagtttttccaccctgagttcaggcagtcctgatcacaggatggatcctgtgctggtgcgattgccactgtgtactaggtgttttccccttggctcagctgaaacatgtttaagatatttaaaaggagttttactaagttctgtgccccctctattgtgggagtgtcagagcccatctgggcccgttgcagcatgtctggccctgtctgagagggcccgcaggggctgtgttaccaggcggctcccaggcgccttttgggaaaacaaaatgaccaggtgtgttagggccagcaggcttccagggccactactcaaaggcagccaggggactttggctgcccttaaactctctgtgcagtggggggcaagcaggcatccagaccgaatggaacgaggtggggtactcaaggaatatggcatgtctcacccatattccctctcagctcagcctctgggggactggggccaagtctcagggaacagaggagtctgtattaaatggaaggagaacatcgttttgtttttgtttttgtttttgtttttgtttttgagatggagtcttgctctgttgcccaggctggagtgcaatggtgtgatctcggctcactgcatcctccacctcctgagttcaagcgattctcttgcctcggcctcgtgagtagctgggattacaggcgctcaccaccacactgggctaatttttgtatttttaatagagacagcgtttcgccatgttggccagggtggtatggaactcctgacctcaggtgatctgcccaccttggcctcccaaagtgctgggattacaggtgtgagccaccatgcccggccaaaaaaaatcacatttttaaaaacccttctagcagctgcgctatgtgagccaggaatgcagggctttaccccagcctggcgcgggggccccaagctggcagtggagggcaggggaaacacaggggggtgaagagctgcgctcctgagagccagcctaggacaccaaactcatggagaaggggccctgtggagctgaggtgcccgtcctttgagggaggggtctgcaccggaaatgtagggcacaatgggatcacgaggggcaaacaaaacaaccccaaagttgaaggatggaaaagctgacagaatatggatttcctgcttgactaatgtcagcccacaaatagatgtggctgacgtcacttacaggaaccccttccttttccttacctcagcccctccaaggaggtgggtgggggagcgggtgagaatgaagccccatgcccttaggcatccgctgtaggaaaggaagtcacttctctcctacacacccagcatggcactaactgtcactgtgtaccatctttggcagacttgggaaggaattcattccagtgacaaaggtcagatagtcctccccagttaaagaaggaaccctggcatttaactgggtctccctaaggcaaaaatcctggagacaaaagacactggtgacttcccagcagaagagagtgaagggaaacccaggtttggtgtaatgcagcaaataatttggaataatttggggattgacttgactgaaaaaatggaatggtttctcaatgcaatatggatttcactttgcacccacagtcccaaacttagtgcttcagaatgcaaattttatggaaattttccttgctttaccagtttcttttttattttattttctctctctctcccactttctttctcctctctttcttttccttctttctttctttttgagacggagtctcactcttgtctcccaagctggagtgcaatggtgcgatcttggctcactgcaacctccgcctctcaggttcaagcgattctcctgcctcagtctcccgagtagctgggattacaggtgcgcgccaccacgctggctaataatttccctatttcttgattctcctttctaagagatatcagccattacttataatagctaagtcatgtataattatttaatataaaagtacgaaaaaaactagccacgaatgagcagtttaagtgtcaaagggcacaaaaatactgccaatgaggaagaggaaagaacggctgaatacgagatcacagaacgagaaagcggccgcggagtgggactggagactgtgaatcacgcaggtgaaatcagaatgggatcccactcgagacaggagccaggagctagcagcagccctggagccgccggcccagccctgaagccgctccggctgtcgccacagcgagaggaaacctgaacgctctgctcctccacagcgagtccctgcaggtggggacaccgcccacctggccctccctgcgccccctggcggagcgagcctcggcctctcccgggccccggcctctccacgaccgcctggccgcgcgggaaccacccgcggactcgcggcctctccccaccggaccccgcaacaccgcggggacgcccgggaggctactgaagagccagtggcgcctgcctcgatcacacgtcccctgtggagctccacctgcccgcacgccggctcgggcgctcccataagcggccggccgcagaggggctccaagggaggcgcgcgcccgcgaagaagcactccggccccgcaaaggcgccccgcggccctgtccaccaaggccactggccgacgggtcggaagagagcccttcaagacggaacttgcattgcgcttgttagagaaaattatgtgtaaaaactgagccattcagctttactttccaccccgcgttgatgtaaaacatgagttcctatggaagatgaggggcttcgtcaagtgtgtaaaaacaaatgctacctctttccattaaaaatttatatatgtatattcattctcattgttgaaaatacaataaaaagtaataaaaaatcacatgtaacgtcataagaaatcaacttaatgtttacatgtatgaaaatcacatgtacaccttgggaagctgaggcgggcggatcacctgagaccaggagctgcagaccaccagccaggccaacatggcgaaaacccatctctactaaaaatacaaaaattagccgggcatggtggcgcacgcctgtaatcccagctactcaggagggtgaggcatgagaatagtttgaacccaggaggcagaggttgcagtgagccaagattgcgccactgcactacagcccggatgacagagcgagactctatctcataaataaataaatattacatgtaacacaaagaaatcaacttaatgtttctatgtattttccaggtatttctgcacctatctataaatcggtaatatcctacataatgctattttgtacgctcctttttcaaatattacatcatgaatattttcctaccttactgtaattttcaaaagattgatttttaggccgggcgcggtggctcacgcctgtaatcccagcactttgagaggccgaggcaggtggatcacttgaggccaggagttcaagaccagcctggccaatatggagaaactccgtctctactaaaaatacaaaaacttagccaggcgttgtggcaggtgcctgtaatttcagctactcgggaggctgaggcaagataattgcttgaacccgggaggtggtggctgcagtgagccgagatggcgccactgcactccagcccgggcgacagaatgagactccgcatcaaaaacaaacaacgaagtaacaaacaaacaaacaaacaaacaaaaacgaaaacaaacacgttgatttgattttttaaaattcttgctaactacccatcatatggatgtgccatacttgtttagccattgaaatcctagatgtttacttggtttctcattcttttctattataaactgcaccatgcagaagaggtttgatgtaaattgattattctattaaaatagcttcctagaaagagaattcctggatcaaagttacaaactcaaggctcctgtgacaaattgttaaattgttttccagaaagatggtctaatttccttcttgccctcagcgtaagacaaccccatgcccgcccaccgccaacaataagaagattctccagcactgagttatatttatttaaaattttgtcaactccagaggggaaaaagtaattctccttgtagttataatttgcagttctttgattagagggactgaatatgtgttgtgtgttttattttattggctttttgtatttcttcctttgtagttggccttatcttcagcctatttttttcactggggagataagttcttctgattagtttctaagactgctttgtataatagggatatttacctcttgtcatgtttgctgcaaatactttttctagcataacatttgctctttaaataagttcatattttttgagggactgaaatctaaaattgtgtgtatgatgtaatcaaacacaccagttttttccttcatgtttcttctgagattttatgcttaacagttctttctcctctcagggctgattaaatattcactttgttttctggagcttgctcatggtttcttcttttacatctgactttttaatccacctggaatttattttggtggctggtgagagctagggttccaatttgatttttcatccaagcttccaatttctccattaccatttattgaataatctatcgcttcccagttggttttctttctcgtatattgggttctaacatagtagggtttatttcagtgttttccattaggtttcattgatctgtcattattgatttttcagtaatgccagagggacttaattactttcagttttataatacattttaatatctagtagagaaagccccctcaatggtcttctctttcaaaaaaagttaagctattctcacttatttattaaaacatcctaagaatcagtagttattctccattaaaatttctaattttgtgttttcttttttctcaattaaatttatattttagaagttggtatcttttggatttataaattatgtttttctggtttttaaattcattaattcctatctttgcctttgttataaacttaatcttccctcctgaggtttgttttgttcttctaatggattcagttattttctctgttcatttttttctgtttttgttattaaaaatggggtctccctatgttgcccaggctgaggcagtggctatccacaggcacaatcatagtccactactggctcgaactcctaggctcaagtgatcctcccacctcagcctcccaagtagctggggctatcagtgcacaccattgtgcctgaaaaactttaaggatgtttttcatctgagtacacctttggtcacatcctgagtttttacgtacagggtcatcattgttgtaattttctaatagcctttaacggtagttttgaattctctgttgtaattgaggagattgctttaaaagtcccaccaaaaagttgtcctttaattggagttttataggcttgtggtcagagaatacagcccgagcaacttttctgatgttttgaaatgtgtgaccaagaagttgatcaattttttaaagtgttccctggatgcttaaaaagaagatgtttgtttataggctacaaagtgctcaattaatttaaacatttaaaaattcagattatcaatctcattttttgtataaaattcacagttttactgtatatagcacttttatccatattaaatggttcttttggacaatttaatgatttctgttttgaattcattttggtttaaaatgagaatttctattcgtttgccatctgatttgtacttacctaataaatctttgctcttcatttatttttgggtccttctgttctaggtacttcttttgtaaattgcatgcaattaaattttgcttttaaatctcatctaagagacatttacttttaacaaggaggtaaacacaattatgttgattgttataaattttaagtttgtttttctctgatcttctttcatactttgtattgaaattcttccttcctgcttcctttattttttctgtcttagctatgtgggctctgatgtggcatgggaggtatatgttttcagggtagggaaaaggctctcaggctggtgttggagtctcaagtctgctggctctgtggcctgaggcacatcgctcaacctctctgtgtctcaacatcctcatatacagaatgcagatacagtctcatagaactatggtatggattaagtgaaacaatatatggctgatgctactgttattcttgttatactcataaaattttgcctgtggttcctttaggttttaaaaaaaatatttctctgattgctaaaactgagtaatagggctttattttaaaattctcctctacataggacaacgcatctggcatgcttttactaatcccttctagccttctcctctcaaatttttaatctgaggatttgcaaccctctaattattattgaattattgctttaatttcatacatccactctttccagaatctactttttctttgacattagaatttggagttttgcaactacgcgtaagtttagtcttgatttcatgtttgcctgtgtgaaccaatgtctgcctttctttacaacatttcattattaagatcttaattgtgattcagtctttggtcaactggcaaacgagttccccccaaaagtaaactccaagaatgacttttgttgccctttggttgcctcattcaaatgacagggtggatccaaatttaaaatactgtggaactgttctaatgactctgaatttagggttcctgagggagagtcagctctgggatgcctgtgtgcctctaggattgtttcaccttatgattcaataaattttccagaaaaagaatgtattggggtatgtctaggggtggctcctcctgtcccccacattctaactggaaaagaggaatccgtttcgatctgcctactctgatctaccatccccacacacaacatccccttacctaggccaattctgaaaatgtttactgtgcgtatatttctgattatgcttttatccaaatttatcatttcttcctctgaaataactctaattcttagatttcacctggatcctatagcctccagttctgtcctattcatcctttctcttatctcttctgcattctgagagagctttaaattttttaagtttgtctccacattccacatttttaaaaatgtagtgccatcaatgtggattttcattttgctaaaacaattttagttttctggaactctgtgcttatgtgaaccagatacattttcatttcacatctgcccactcttctctatcataaggatcatatatattctggcaccctattagagatgcccaagactcttctttctttttccttttttttttttttttttgagacagggtctcactctgtcacccaggctggagtgcagtggcgcaatctctgctcgctgcactcttgacctcccaggttaggtgatccccccacctcagcctcctgagtctacagatgcaccaccactcccggctaatgttttttttggtttttttttgttttgttttgttttgtttttggcagagatgggtttttgctgtgttggtcaggctggtctccaactcctgacctcaagcgatccacctgctttgacctcccaaagtgttgggattacaggcgtgagccactgtgcctggccacccaagactcttctaatgttgctttttgtttttcataattaaacatttttcaggaatcttcaggattattttcctcttccttaatgctgcaggtttttctcaaaggcctccagcaggatccctgtcgcctccccaccttccccctccccagccatctatctctccgcctggcaccagaaggggatcgctacaggctgctccttccctacaggaggctaacttctcacttctccagctagagggcagggttcctgggtctagcaggcttcatcccatgtggtaggctactttcctatcctctctaactagtcctctgatatcataaaccagtggtttgcaaacttttaaaatcatgggctcctaccaattaaaaattttttgagcatgccctcctccattatacatatatttattataaattacagacatgtattgctctctatccatttattaaatactagccaggctttatatatatatatatatatatatatatgtagaagttctgatcatttctcccaatagtcccatggatcactgtgcgtgtgccccacattggaggttataactcaaaccaaagcagtccatgaggaaccacagtgcctggccccactgttcccaggctctgctcagttctgctcagcctacagggtttagcttgcaggcttccatcaaccccatgtagggtgcttcatccctgtaatgaccactttcctactgttttgttttggggtttgtttttttttttttgagatggagtctggctctgtcacccaggctggagtgcagtggcgtgatctcggctcactgcaagctccgcctcctgggttcacgccattctcctgtcccagcctcccgagtagctgggactacaggtgtgtgccaccatgcccggctaatttttttgtatttttagtagagacgggggtttcaccgtgttagccaggatggtctcgatctcctgacctcgtgatctgcccgcctcggcctcccaaagtgctgggattacaggcgtgagccaccgagcctggccattcctactgttttcttggagtggaagtaccccttcttggagggggtaggaggttgtgggaaggagatgggaggaggagggagctgtggtcttgcttcctgctgctggcaagtgcaggcctgggtgtctgaggcaggggcagaagagagtacagcaaggaagcctctttttatctccttacaatgggagtggtggctctcttaatgagagaaagaatgggccacaaattgtttttctcctgctttaggagccagatctccagaataaaatttctcattaaaatatcagtatgccaaaagttaaccagcaaaataaaaaacctgttgacagactggaaggcctgggacactgagacagcctgttgcagaatttggagcctcaggagggaccaaagtgaagggtccaaagggtccgaagggaatccactcaagaggacagtaaggtcatttataaagcatggctgtgacagcaaggctcaccccacttcatcaatgttatgggaggccttgttgctcctcccaaggagataaacatacaaaggtgagctggcaggccactgcactgctcaaggcacgctaggaaggctggctctccaacctgctgccgcagtgaggacccggggcctcagatggtctctccaccagtaaagctgcttggcacttgacagtgtaaaatcaggaggttcctccctgagggaggtgggcaggcagccaggagaatcccagagaatgcagagtgccacaactgtcaggcctcggaacccatgatgtaatgcctctctgggggccaaggaaaacaagcccactgttgtcactgccctcccagcaaccaggcgctgccctccccatggcacggctgttctgcgtaattatgatcccactttctctccttgggaggaggaaatatgaaaaacctttgttgtcacataaaaaccaacccaagatatgagaactgtcttttaaaatacatcttgctgtagagagatttccatagcaacttcagaagtgtgtgtatacaactagagataagtccaggctgatgaaagctacctggaatgtgaacaggctctgggcatcagcagctgtggatttttctagaacctgtcatgctgctgtgtgaccctgggcaagtcacttaccctctctgatgcctaaggtgatagaatcatcattagatcaggctgagagagatcaaggcatcctgtccacactaccctggtctgacgcttcagttccccaaagcttcccctgcttccagcttctgtccagtctctggctgaataagtcctggctgaaggcctctgccaatcttacttattatttgacattgggaaacagaatgatcatttaagcttgattctaaaaatagtgcttagtcttggtaagagaagtgctttgcctgtttaggaaacaatatattaacggggcagattcctgggaaacagtctgtgagatgctgagatttgggggtgggagttttactggggctgctctcaggatcaatacctctggggtatagaggaagttcccggatgcagtggtaacagaggccttaggcgatccctcagggaccctggagcctggctgagtgtcctactagaagcaaacggggttaggcctttgaactcccacactgacaaatcccctcgggagcttgctgcccccaggcaaggggtttgacctgaagagagggactcagtcacaaccccagctaagggaaggagagcccgggtcctggagggggcatctgtccccttcatgttgacatgaagcaacatgtcatccactacatggatgtgtttgaattggacatgaaggcagcccaggaggctagtatgataacatggtcaagaccataggcagcagaggcagagaaaacagcaagactgggattcacatgttagtctcagtggccttaagactctgagattgggaaagttgccagtagagtagaggccaagatttcctcgtatgtgcaggattcagcctgggttggtgacacacacatggaagttcagagtcagaaaccagttcagattttggctccacgcttattattaatagctctgtgacctcgggccagttactttctatcagtttcctcaactctcccatgagccttcatgtccaattcaaacacatccatgtagtggatgacatgttgcttcacccaaatgcccctccaggacccgggctctccttccctcaggcaaggtacctctctcatagatctattgtgagggcaagctgggatgacatatggattttacacagaactagcacaggggtgcaacaataacatccaccatgctttaatacacctcatgttatacctaagtctttggtcaaatggccttttcgcaagagaagggaactttcagagaatttccgatttgctcattgttcctctgtgccttggtcttagcgggggcttgtgacccatgtctgcagagagagagagagagacccagtggcccaccagggaccaaactaacccagcctcagcttggaagctatggaaggccatgcaatatcaaataaggtgcatcatctaagtactttgcaaactacattctttaaaacaagcttattttccagtgaaaaatagtcaccccttcttgtgataggttcaataaactacgaaactcacttgcaggtactttgttgcatgttcagccatctgaaatacatgccagagagcatctgaggaagtgaaagacttcaaatagcttaaagggctacgcaaattcaattactatgttaatagacaacatggcttccatcatttagaaaggaaaacaggaagagtataggcccatgtatggtacaagttgggctgttctaattaaaagaaggcagcacaaaattcccaagagttatcaagggatctgcactattattattaactttcaccatcattggattgcagtacatagtgcatatatacaccttgtttgactctaacaataaatcctgtgtccagctttcagataagaaaattgaggtccagagaggtgaagcgaccagcacaatgttgctcagctaacagtaccatgaagagtttggggtcggaacccaagcacatgctttctccattgggggaagagtgtctgcttaccagagaaggctcatgaagccctgtgcagtgtggtcccactcagagcagatgttgcaatgtcagctgctgagtaatggcgaggttctgaataggtgagcatggtgtgtccctggggctctgtgtgtgagaaaggtcttccaacactgcactggctctcagaacctgaacctgcatcctggagcctgaacccttgttctgcggcagcagaatgccctctcagtttgaccgtgtgtctgttggccaaaacgctgaaagaaatgtctgcaaacagaatgtctcaaaaataggtaggagatacgattcaaggcacccatgtagggtgtgttgaggctaactcctctccagacttctttgtcttgtttgatctctgctaggacactggtgcatggaagatttggcaatataatcgtaagtgttgacaaattaagggcgactaccaggatttgtgtaaattacacaggatgcttcaccatacctcccaacataataaaaataatctatctcaagcaaacatagcttcattctatctcaagtgatcctcattttaaaatgaggaaactgtagcccagagaggttaagtaacttgccctaggtctcacagctacttaggagcagaatcacggtttctaacctagatttagactccacatgtcaaatagattaaaatgaatatccagggctgggtgcagtggctcacgcctgtaatcccagaattttgggaggccaaggtaggaggatcacttgaagccaggagttcaagaccagcctggccaacatggtgaaaccccatctctactaaaaacacaaaaattagcctggtatggtggcgcatgcctgtaatctcagctacatgggaggctgaggcaggagaattgcttgaacacaggaggcagaggttgcagtgagcagagactatgccactgcactccagcctgggcgagagagcgagactccatctcagataaataaataaataaataaataaataaataaataaataaataaataaataaaatgaaaatccaggaccccttgcaaggagaagagtcattaaaggcagctcgagggtggtggaaggaggtggcttcagtcctgcccttgagccttgttgatggctgttccaaggagttggcattttgttctacagccctggatctctgtcaggccacatctcccttctttcccatgagtagcttctctgaatgactcccaaccaccagcctcctaaaacaatgtttcccaaagtatgttccatcagtacagtgcttctcaaactaaggtgcatatgaatcaccaggtgaccttgttaaatgcaaattctgattcattcattctgggctaaggcctgagattctgggaactctaacaagttcccagtgatgccagtgctgctggtctgtgaaccaaactttgagtagcaaggtaccaatagtgctttataataaaaaggatttgcaggcaaatacaattaagaaaggctgaaccaaacaaaaataaatggtttcattacttcaggacttctcagagcctttaaaatgctaataagcattattaatacccaagaggagtaagttgcaatgtgttatatgtgagttactgatgtaaccagaatgctttgatatattggtttgcaaagaaggaacagaaaatcaggaaaattctgtgcctttttcccaccttactttggttccaatgctgcaattctagctcatactgaaccccaactcagcactcccctctttcccattgtctcctttcaggtgtctgggtacatgcctgtctcctccatcagaccacatacttcctggcacccctactcctcctcccttccctgtcccagcacaggctctgtactcagaaagccccatgtggaatacctttcacagacacggacggtccaggcagcaatgatccacagagagatgctgaacacgagcagcacagtgccagggcagatggtcatgagcgtcttcatgacaaagcgggtgttgaagttgatcttgttgagggccccgatgctgcgggacgaggcatcggtgaagagcttgctgtgcagcagcatgactcgggcgatcaggtacaggcgcaggaacatggggatagacaggatgatgtccacatcggcctccgcccgggagggtgtgtaggagaaggccaggcgtgccgtccagaagaacttgtactcgccaggaatggggtggatggcgcacaccagcatctccaggctgatgtacaggatgcgctcgtaggtcatggctatccgccagtcatccgcgccattgtcgatcacgaagagctggtgggagcagaaagtccattagtgtggccaggaccaggaagcccacagcagggtccaggcaggacaggtggggcaggctggggcaggctgctgggctcaggtcagcctgaccacctcagcatgctctttaggggccttgctatgtggcaagagccctgtatgtggagtagggagagctggattcagtctacctgggaagccctggctaagacactttgactctcttggcctcactttcctcctctgcaaatcgctgcctgagatatagtgatttataataagaaataatgtacttggtctttatcctggtttaggcacagttcccaaaacgctcggaatttccaaagtgataagtgtcatttgtatgctaatgagatgactagtggctggggtcggtcggggtggggatccagggtggcctcaggatggcgctggttgccaggggaaccaatctggtgatgagagggttggaactttcagccccaccccaccacctcctgagaaggaagaggggcccgaaggttgagttgatcaccaatggccaatgatgtcatcaattatgtcggtgtaatgaaacctccacaaaatcccaaaaagacagtgttttgttttgtttttttaacttttattttaggttcaggggtacatgtgcaagtttgctatataggtaaactcgtgttacagagatttgttgtgcagatgatttcgtcacccaggtactattgggtacagtacccaatagttattttttctgatcctctccctcccactctccaccctcagtgtctgtcgttcccctctttgtgtttcgatgagcttccagatagctgcacacatggaggtccctggacacgtggagtgttgcgtgcccagagagggcatggaagctccaccccttcccatgcgccctgccctttgcttcgctcccatatggctgctcatctgaatcctttgtaaggtcctttataataaaccagtaaatgtgtttccctgagttctgtgagctgctctagaaaattaatgaaaacctgagaagggcgtcctgggaatccctgatttatagccacttggtcagaggctcagataaaacaacctggggctggtgactagcatcggaagtcaggtaaatgtggtgggactgagccctcaacctgtgggagccaacactaactccaggcggacaatcaggcttgagttatattgcaggacactcagccagtgtccattggagaattgcttggtgtgtgggaaccaccccctcctttttgctgaccacaagtgttctatgttgagccacttcccaaggtcccttccagcacacaggtgccaaattggctgtttcacgatggtgagaaagatcaactcatttatattagaaacacatccctgagcccctgccagacctgagctgagccctgtaaggggatgtaaagatgaaaaagtcatgtttcctgcatgagtgaactcacaagggctggcacagattccttctccccactcagagaagggggcagcaagtgtttgctggcagcactgtgctctcagacagtgcagtgaagtgttcacggcacggactctggagccagattgcctgatcctaacactactggctccatgatcctgggcaaattaccgaaccaccctgtgcctcagttacctcatctggggatgatgataataactgctgcatagaggtcactgtgaggctgcagtgggttcgtatatgcaacatgcatggaatcctgcctagcacccagcacactatgtaactattagctattcttatttgtagcattattaatggatctggtctcggtctttctgtaaaatgacagttgggctcagtgatgtctaaacttccttctggccctaaactttcacgaagatgcttcctgctgtcacctcatgaggatggctgttctcacaagaattgactgagcacctgctgtgtgtccagcctttgtcttccggtaagtcccactgtggagtcccaccatatttgatgactgtgaaagggacttcacatccttcccctctggggcctcagtcttcatctgagactgaaatgagaagcctctaaagtctcatccagctccgatgatttgattcttggagggtgaggcctgagatccgggcatatgttcggtgtgggcctcctgtgcaggcacctcacttctgggaggtagtggaatgtttatcatcacactatgccctctctttactgggtccttggccctccagcagatctggctgttgcctgtcccagctcatccacgaacacatcccactcaagactccagcctcacatgctgcctgctccaccaacagccacagagagctgctgctctccaaagctggttatgattgcctttaaggaggagctagcagggtcctgtggcctaacatgagctcaggatgaagggtaccagcatcagcacctcctggctgggagagcaggccatgcatgcatcctgggaaggcctgagctgcaaggccggaagaaactaggctgggttaggagaaattaatgttggggccagggttgggtggaggttttatttaacctggaaatacaccctcagcacagaaagcgtaacagagagactggatcagcgtggatttgcgggggctggctgaaagccgagtgaagccttcctttcctcccttgcacagggagatcagggaatgaggagccctttattctgtccacccaactgtctccttgatggtctgggccaaaggaagcttctgctctgcttcaaagttagtcaccaagcagctttctcactccactttgctgccttccttacagttcagcaagaactgaggacccaggagaggacctatggtaccaggcctggtgtggtgtgggcgggcgatgcttgccttgcttttagcatctacctgtgatatgtttctgcagcaaggggaacattccaggcaattcatgggccctgagaggcacagacaggggaggcagcactaggaggcaagtctcttaccttgccgagcctcagtttctctttctccctgctccgtacccttacagagccatactggagagcagaggagacaatggattgaaagggtttaataaactacaaaggatcatttgttcattcattcattcattcaacaaaaatgtgttgatggccctctgagcagccagccccccacccacccacccatgaggatcctgaagggaaactacagggcactatgggagcaactggctgagaggctcacctggtggctctaatcagggagctgtcatctctgaacaggagacagtacccagcacagcaccagctggagactcaccctcctccttccccagtgcagctgagcctgggtttttccagacataggttttccccagcaattagaaagccctaatggctgctcaaagggttccctctgcttctaactgccgcccgacaggccaagccatggcaacgtgactgcctggccaaactcttcaaatacaaaattaaaaccatctactccgtaataaagaatcgcatctggttactatagtaactgggttcactctgggcaggaatggaagcaacgagtaacagattcctttgattgcctgatgaggagtgggattgtaagtaagagctgaaggggagaatgcaccggcagctctgcccagcgagacgggagggtgctggtccccagctgcctctcaggtgccccgccttggttgtggcttgctggtgcagggaaggtgggggccacatggggtagtggagctggaggtgggagagctagcctgaagtcccccacatccaggtattagccatgtgatctcaggccgtgcgtgacttctccgagcttgtttccacatctccaacaggggaacactgactgaccttggccctgcctgcctcctggggttagtgttaggatccaataatacagataaaaagttggacagtgctttactcactgctctaaaaatgtgagggattattaagctggctggcctgggggcactcgtaaacagtgtgtgtaaagagcgggtgttttgagtagggggtgggggagagttttcaggctgcaggttaaaagcttctgctagacagggctccgctgcaaggttttctgcatctgcagggtgggatgtgtcccagaagatcccattgctgtcccacgtgaggacactctatgcttccttccttctgacccttggaatcacagctctccaagtgtggcctcgctccctcccgattcagagcaagtagcagataccccaaccctgctgtttcctcactctgggtcccattcattcctaacaaagcacaatcccaattattgatttgcatgtgtgaggttttgctgtctctccccttagacatggttctcaacctacttgcgtcgcacattagaatgacttggagggcttgttcaaaaatacccatgcccaggcccaggcccaccccaggccaagtaatcagaatctctgggggtggagccctggcacgggtgttcttcttaaggctcccaggtgagtctaaaatgtaaccagggttgggaccccccaaccagtcacagttggagctccaaagagacaagcgctgtgtcttccttgttccctgtggcatctccagagcctagcccagatcttagcacttagtaggtgttcaataaatgcttatttagtgaattagtaactcccacttactgcgtgcccctggactaatcttccctctcttgggctcagcgtcctcctctgaggaatgagggaatagactagacaatccccaaggtacctcctgctctaagaagccataattctgtggttctacacagaccctcttgctcgcacctcctgcctcatctgtgttctcggtgcacctgagctctccagggacaggaaccgtgcctggctcatctcaccccactcccatgcctgagacgttgcctggcacagagtgggcagtcagtagaatcttggtgaataaaggggtgtgtaggcggatgactgtgtcatatgaagaaaaggacagattgcctgtggcccttgttaaccacccagaatggaaattcctgttgaaaatccattcctaagcctgtgactcacaaaggacctgacaattcatctcacaccatgggaagggacaccctcttattcccaaagggtggttcaacctggaataaactgtcccaggtgacctccaagccttagaaagttctagagcaagtctggaaccaggatcttgagtagcactggaccagaggggctcggggagtgtgtatgtggctccacaaaggactatcctcccctagggcttagtctcagtcatccagccctgattctagaccagcttgactgttggcctctgatggattctggagaagtactgaggtgatgtggacagagtgtggcatggggcagggagtaccgtgggccctcaagtggtctgttctggcctgttccagagcaggagaagccacagaggcccagggctgacaaacgagtctcttcctgatgaggcataggtttgctccttgtactctggcttccctgaatgggaaaaggaaagccacattcttcgagtcactgactctttctgcctcctaagcctaaaaaagtgatttcactcattgagggtatgactgacctgaagatgcaatgtgtcagtaccacagtctctggtttcctgaaaattccattctttcctcagatagttgctctgtccagaggtggctctaggcctaatccctctaccacttaactggtggttctgagaacttgccggattttcagccgttagtataattctgagagctctgggagggagattttatgcaacagtgattccaaactttcctttaaggagcttgtaattagagaaaaaggagaactaacccaactcagttcaatataataattattaagaatcaacaaggttaggccattgtgggtatataaatctgaatcaaacacatgtcccatgaatcagtgcacaatctcaagtagttctagcaaaagacatgcatgattaggatgcaatttgaaaagcttcttgggttacatagggcttcagcagcgcccggaaggcatgcatcagacacaccagagggggcagcttgcagaaaaggccacagattcctcccatcccattcacttacttctgtacatgtgactttgcctctcttccaatcaagaagtacagcctatttctctctccctctctctctgtctctttttttttttttttttttttttttgagacagagtttcactcctgtcacccaggctggagtgcaatggcaccatctgcctcccgggttcaagcgattctcctgcctcagcctcctgagtaactgggataacaggcacccacaaccacacttggctaatttttgtatttttagtagagatggggtttcaccatgttggccaggctggtctcgaactcctgacctccagtgatccacccaccttggcctcccaaagtgctgggattacacgtatgagccaccacgcctggccagtacagcctatttctcaatcccttccgtctgaacttagccatgtaccttgctttggccagtggaacattaaaaagtgtgatacagcagaggtttaaaaaatgtcatcgccatgaggctcactatagacacatggcctcactatccctttcaccccagcctgcagccagtaccagctgccagccatcagaagccgtcctagaccagctgcatgacagaagctcacccaaggtgagaccagcagaagaaccaccaagctgagcccagcccaaatgactgacccacagaaacgtgacctaaattattattttaagccattatgttttgaggtgctttgttatgcaacaaaactaatatataacaaaactaattcttatatttggcacatattagaaaagccaggtcatgtgcctactgtgcccaacattttccttttagattcttatgccacagcccctagcaggaaccctcacccgtccccaccttcccactccactcagttatatttgctggccagtccttctcaagtaactgggtgactggatggggaggagatcagggtcaagggccattccttgatggccattcccccatccccactctccccatggacacatgatttgagatatcaaagaataactcagagcatttaaaaagttattttgcaagcagtttagttgttttgcatacaaagtgttttctcagatgtgaggaagtcagctggtagactgaatcagggaacaagggcacaacagaattaatgggcaggggggccgctggagaaaaacagcagggagtctgggagcagtggaccttgttggcaaatgctgagggtaaatggattcgctggcagctaacaaagaggtcagcatggcattccatccttggacggccagcgagggatagtacagaaagcactttcagttattcagggattcttcagaagcccttggctttcagctgtgggtgtgtcacaggccctctcccttgtcacctgcacctcagggagtccaggtctgacctttccctggttagagtgtctcgccaagcaaagatgtcatcaccagctcaccacaaggccaacgctgaaggccatctggacacctcaggacagggccgttcagctgcaatctctgcagggcctgggacaggctgccttgacaaggagacaaggacactacccagtgcctccagcagccacatggcacagcccgagcttcagacttgcgaggcctccccacatttcctgcaaaggggtaggcatgcagggaagcttgccttttttctttttttctttttttttttttttttttttttttaggataagtttagagtcgattcattggattcactcgtttttccccccattctattttgaaagacttgagacctttctgattttttatttaagcaaaatctgtcattaaaatgttctcagctatcagggaggagagcgtattcctgcttagacactttctgaccaacctgaaaaactttcactcttgcacaactgtgaatttctctaaattaaaggagagaaaatggaaaaagcctttttgtgtactgttctctctctgtggggagaagaacttccgggaaaatttccatcatttaaaaaaacgacacagaaacaaagcaagaagaaaaaattacagattttcttaagatatattatttatatatatgttttatattttatatatatatatatacatatataaatttaaacaccctggagcatatattctgcatgtacaccattactacgggggttaccatggaagcaacatcaaaaatcctgtagtacctaattaggtttccctgaggacaggagctgattgccagtgacgaaatgaacttctgggtttgcagcaatggttggtaaaattaccagtcagcaaatgctccatggaactagaggaagaaagggaggcgggtgggggttgggaagcaaaggtggaaaaatggtggctctaaaagaggccagccagtgaacaggccttgtcagggaagtctatgattctaccataaacaagatgcttagggcgttggggtccacgctaccccgctctgtgtctaagaagaaattgtcctcatctgaaaccatcccactccctgggccatgtgtgatgtcccacagtggctctttggtccggccaggataggcttctcctgagcgcttcgccagagctcacttttggtctcttgcagtgtgtaatgaccactcatgggggttatggagtctgaagtttgtttgggactaacagagaccagtggtgatcataaatcctttcccctgtcctcagttctcagagaaagaaagccaagtttcggcatttgagcgagccactattttttactcacgtagcaggaatttcttgatccctgagcacgtcaccactagggatagagcatcccacctctggccatctgtgtgtggcaagtctctggacctcagattcctcagtgtaatgtgaagacttggatgcaatttgtggttttccattttctctgggctgtggggccatttctttcataagatttttcatgtacgcccaacatgggaaacagacaaattcagagctgttgtagttgaaagggtagagaagaacattcaaagatcaactcactcacctcctcctccagcctaggtctctgtagtggaccccatgctctccatagaaccctttgactggaaatcctttggatggaccagctggtctctagttgtaaggagagacaaggtgtgatgctggaaatcaagtgtttggggtctggttcaagaggtgctcgatgcacaggcagggagctttgccccgatcagcttattcactcattcattcattgagcatgagttgagcccccattatgtgacagtccttggtaagctctagggatatagcaagacaagtagacaaggcccctgtccccacagagcttacatttcaggggaggaaaacagatattaaacaggtaaaccatttaattttagagagtgatgcctgccaggaagagaataagacagggcaaaggaaatgagagaagtcccagacagccaggacagggagggctctctatggaagggacctctgaatccaaagtgagccttgcaaaggtatgcattacagaggggacagcatgtgcaaaaaccccaaggcaggatggagcttagagagttggagagataaaagaaagaagaccaatgtgagaaagaagtgagggatgataccaggtgagaccaagaaggtagcaggacccagatcattgggaccttggatgtcacagaaggagcttcctcaaaggacaggagaccacagacccactcccaccagggccatgtgcaccatgtcaccactttctgaaaacacactgcccacaggttaaatatgcaccacagctcgggcctccgaaacaaaatatcatagactgggtaactcaaaaaacagaaatgtattttttcacagttctggaggctggaagtctgagatcagggtgccaacacggtcaggctctcttcccggcttgcaggtggctgccatctcactgtgtcctcacatggcagagaaagggagagggatctctctttttctcttctcctagagctgcagtcctataggactagacctcatccttatgaccttatttaaacttaattacctcccacagaccctttctccaaggcagttacattggaggttagggcctcaacaaatgcgttttggggagacacaattcagttcatagctattcccttttgtgtcaaaattacccaaaagccagactgtgggccgagccaggtgattctgcacataccatttcattgccatctcataatgtccctgtaagggagtcatacatccatttagcagatgaagaaacccaaaccaagacaggttcaatcaattgcctggggcttgcagcattctgtgtcttccaagtcccacgccctttcacctgccagcctgctaagcaggcactctatttgggggctggccagtttgggctttactttgtcttctaaagaaaactcggctgggcgcggaggctcacgcctgtaatcccagcgctttggcaggccgaggcgggcggatcatgaggtcaggagattgagaacatcctggctaacacggtgaaaccccatctctactaaaaatacaaaaaaactagccgggcgtggtggtgggcgcctgtagtcccagctactcgggaggctgaggcaggagaatggcctgaacccgggaggcagagcttgcagtgagtcgagatcgcaccactgtactccagcctgggtgacagaacgagactccatctcaaaaaaaaaaaaagaaaaaagaaaagaaagaaaactcaagcccaccctttaaatgctcattctcagaagaatctttgctgaccagagaatcaatatatgattaaaataaactgggttctatccctggtgtccacaccacctgggaaacccacatcgttatctgtaatctagactgggctatgtttgtggaactaagaccacggctttcatttccacagatacaatatccatttatcatctttcccttcctcctcttcccgccagtgaacaggcctctatggagacctggtgatggggtccctagcgaggaagagaccatcttagtttaggagcccacttatgcaccccagcatgtttgctaatgaagaagattcctctggacaggcttggggtggggtcagaggagaccaacacagggcttaatatatgtgccctagaaatgaacaggaacactggagatgggggattgtgagctgtgggactggaaggagaggggagctggctaagcagcaccttgggccagtcccatgagagggggaggccggagcccactgaggacttgaccacccatgagacagggacagtgctgagactgtaagatcaggagcatgtggcgttcagcgctgtcttatctgttgtgccaccaccacctcaccccttccccttgctccagatccatggaaatgtcagctaacctagaggccttggtcatgggtccctcgaggagcaacaggaacaggaagggtgcctaaagcggttactaagtacaggatggaggtggagaattcagcagaaagagtttggcatcagatgagctgtcaagagagaaatggaagtttccaagcccccagagaccagtggaaagacaccgggtcccctcctgtgtggggtgggagtttgtaaccaattatatttgaagcagtaaggccaagtgaccccggccaatccttgggttgctgtggccacaccttggtctcatcatgtgctccaccccagccatctttacattgctgccagagcaaatgttctaaaatacaaaccaaatcatgtcacctccccttctagaacctttccgtggcaacccagagtgtccaccctcctagctgcacttggccaaaagggccttttcccacctggcaccagctggcccctctatccccatcacctgccacacccggtgtctcatcccagctaaaccaagttaccagtaacccctaagcttgcgcccttccatcttctgtacaagcactccctcttctcagcttcttcaccagagacctccagatccagcgtcccacccttccacaggcctaagctggtcccttctgactcccaggtggggctgggtgccttcctccagtattccccaggccctgtgccccctgcttgtcacagagccaatccccaaatggcagctggagaaggatggccagacagttggggagtgctagcccccgtttcagggggcggagggagcagggcggcggtctccattaacaatggtaacagcaggggccatgtattgcagcctcactgtgcaccaggtcctgtgctgtgtgccttacaggcaccatctcatttagtccttaacaggattttgagacaggtattcttatttctattttacagacagggaaactgaggctcggagaggctaaataatttactacaggtcatacagttaataaggggcagacctaggctctacagccagggcaggcagctctcttgactactgtgtgtgctgcccccaggctgtgctaggaaggcttgttgggctgagccccagtgtttgcctatcccaggccaggccaataggtgtttctggttctttgtgtgccttggcagatccaggagtcaaaggtttctgtgcatctgctaagtctggggtaagaggtatcgttttctcaacaggaagtttctgataagtttctttccttttgacacatgaaaggatcctgctgaatgtttgggggtaggggaggaacagcatcatcactggggctgctgggccctgattggttctaagtcacctgtttaccactaagggagaaattctttaaccctggcttaggggatatttttagcaactaaaaataaataggtttttggatctttgaacagcctagggagctgaagaactgaggtcaggaccaggtggtggtggtgggcagggagtgtttgttttttccccaactgactaaaaggcccttcacctccttcccaagggccagctgcactgtcaccccttcagggggagcttttcctgatctcccagtggcgggggcagcacttcaaacagcaacaagccatttggtgagtccaacttgttggctggggcctaagcacttttctttttctttttttttttttttttttttttttttgagacaagagtctcactctgtcttccaggctagagtacagtggcacgattatggctcactacaacctctgcctcctgggttcaagcaattatcctgcctcagcctcccgagtagctgggattagtacccagctaccacgagtagctgtgcaccaccacacccggctaatttttgtatttttagtagaggtggggttttgcgatgttggccaggctggtctcaaactcctagcctcatatgatcagccatcctcggccttccaaagtgctgggattacaggcatgagccaccacacctggcctcctaagcacttttctttacatcaactctttgagtctcacaatagccccataagaaaagtgaacatcccccagacctcatagcaactaagtggtggagacaggatttaaaccaagaggccacactctcatctattaagtttccattctggccgaaacctccttcttgatcgtccatctgagccgcattcctgtccacctgcttgtcagcaccctcactaaagcaggggtccttgaggacagacatctccttggtcactgtcctccacagtgccaggcacagcgcccagggccacccaaatgaatacataaagggtttaaggtgtcaaaactatatcaatgtgactgtaaagaaatattttaattgttcaccatttttataatcctcctaaggcaaaagagtcttttgtaacatatgcacaagatagaaaaagaaatcaaagaatattttaaaagaactgcttattataattttttaaaaaaccctggaaacaacctgaatacacatcaatagggaaacagctgaatatattatggtactcatactggggaacattatgtagctgtttttaaaaatgaagtggatctatatgtattgacttagaaaatgttcatgatatattgctaagtaaaaagagaaacttacagcataatgggtatagtgtgattcctcttttttaaaaaagcaaacaccaacacataaaaacaaaaatgcccatatatgtgtatgcatgttggtacatttttgtataagcacacacaaaaggtgcattaatcacctctggctaaacactaaattgttaacactggtactactggggacgcagggagatgggaatcagggaacctattgatttttttccttttgataatgagaacacacctctgtgttaaaagaagcctatattgcttttgtaatttaaaaaaacccaataaagtattttttaaaagagctgtcatggagaaagccacttgtggcgcctaatggtgatgttttaagcatggccattcttggaggaaaaataattgcccaggtcctttcctgccctgtaattttctgtgtagagcttcaaatcccctgggagcccccaggattttatgaatacagccctgctagaagtgttcatagctgagctcctctcacaagtctccccctccaaggccagcctcattaccagatccacagcccctctaactaagccaccttgtgaaaaatacttccagggcatgaagattaaacaaggcacttatttcaaggccacctctccatgtgaattcctatcgtaggcactgaaagccgcgttagtcagtggcccactccgctcccccactgagggcagaggcctaggctccctgtgggaagtggtggccctccccacggttgagaaaggaaacctgctccaccattccctccatttgggagggagggaccagggccagggccagggccagggccagggcatgcggcagccaccatcaccacagcgactgctgctggtgagaggtcactgcggatctggcctcagcgtgccaggtacaatgccaagacccgtggggtacagcggagatcaggatgcaagttcctgatgaaccaggagcttagaactgcgtgtctgctagagatgcgcagaagcaaacaaagatatggctatggagagggccagtttggtgactgggggcactatttgcaattcggggtctgtgctgctgtgtgttcaatgcccacaggtactgccctggatccagacacctggagctctggctctgggtcccccacactagagggccctgcttgacccctccttaagtcacaccacaccccgtggagtcagaagcccacagggccaagaggccttgtctgcctccaccttctaaacccccgtttggatatccagacgcccagagtcccctgtccaaaaaggccccaggcctgcttccagggcccacgctgccactttctctgtcctcccataggctgacgctggctgctggtaggtacatccctaagcctgagaagcagccaaggggtagctggaggagggggcaggatgaagtttagatctgagggctgtggcatccacagtgccctcagggtcttagattgggtcaggagggaggcaagagaggggcatgctagggtctggggcctcagggtctaggcgcctccactggaggctggcccaggccctgaaggaaacagggatggatgggcctgtcggtcaccctttctgactgtctgggatatgaatgacaggagcagcagcagctgcattttctagttagttctgaggtcaggcaaacaggcccctgacactgcctctcagatgggttgtcccaccttcacacacctctgtagcaggcacaggtatacaggcttgctctgaggcgccttctgccgagtgctggccatgttggaagcaccatacaaagtggttgagtggccaaatgtttgaaaaatgcttctcagagattcatcaggctcattagcatattaaagcttctgagacttctaaagaaaagaaaacaagtcggctttgaaatgcagtttctcaaacttatttgaccttgactcttgttttgaagtaacagctattaatatttcaaggaacactgggaaatgcagggtgtgaggcattcagtgtaacagacaatggagggttcattccttcaagcatccatggttcattttcatgaagattaccatagtcttcctgagaggcaccaaatactcccctgccttcctgaactgactccacggagcacagcccacgccgccaaacccgtcagcatccactcgcatcaccccacagcctcctgtgagccagccaccttcacgtgctttttagttattttatttaacaaatacttaacacagcgtttactaggttccgggtgctagtctcaatgacttacacatactagcttctttactcctcatagcagcccttttgtggtgggccttattattgaaagatgaggaaactgaggcatgaagagattaagtgacatgcccaaggtcacacagctggtaagtggtttactcagacccaggcagtctggccccagagtccacgtacactcatttcttattgctgctgtaacacattacttaaaacaacacagatttattatattacagctccggaggccagatgtgtggaatcagtttcactagactaacgtggaggttgtccgcagggctggctccttcccgaagatcaggcgggggaatccgtttccttgcttttccagcttccagagagggcctgccttccctgcctcgtagcctcttctcccaccactccagcctcctgcttcaccatcactcgtcctgcttcctcttcggtagcttcctctgcctcccttttcacaaagacacttgtgattacgtttagatcccacctggataacccaggatactctcctccatctcaagatccttcatttaaccacatcctgcaaagtcccttttgccaggatatccagggattaggagctggatattttggcagggtggtggtcggtggggcaggggggggcattatgattcagcctaccacattatgcttttgaccattgtgctaaatctagtttaatcttcctaacaatcctaggaagacgttgtcattatttctattttacagatttgaagactagggctccaagacgtcagctgaactgccaagtgtcacccaggtagtaaatggcacagctgggacaggaaccaagaagtgaatgacttgctccttcacacctgccctgccatcggagaggcggcactcaggacaggcagggccttgggggattccgaaggaggtgctgcttttgttactctctagactgagccctcctgacatcctaagcccactgaaaacctgatgcgagctatgaatttgctttccctagaacaagaagcatttacagaaacacaccatgtattgcagctagtttctgggagttcacgggccccaggttaggaatgcttgctttttttgtttgtttgtttgtttgtttgtttgttttgagagacagagtctcgctctgtcgcccaggctggaggagtgcagtggtgcgatcttggctcactgcaacctctgcctcctgggttcaagcaattctcctgcctcagcttcccaagtggctgggactacaggcatgcactacaatgcccagctaattttttgcattttttagtagagaaatgaggattcgctacatatatggcaacatatatgttggccaggctggtctcgaactcctgatctcaggtgatctgcccgcctcggcctcccaaagtgctgggattacaggcgtgagccaccatgcccagccaagaacacttgcttttaaaagcagagtatcaaagggatgtttgcacacccatgttcattgcagcattacagatactccttaacttatgatgggtcacgtcctgatgagcccgttgtaaattgaaaatattgtaagtagaaaatgcatttaatacacctaacctaccgaatgtcacagcttaacctagcctgccttgtgtgctcagaacacttacattagcctacatttgagcaaaatcatctatcacaaagcctattttataataaagcattgaatatctcatgtgatttactgaacactgtaaacggtagagtactgtatcagttgctgaccctcgtgatcacagggctgaccggggctctctgccgctgcccaacatcacaagagaatatcatgccgcataccactagcccaggaaaagatcaaaattcaaaattcaaagtacagttcctgctgaatgtgtgttgctttcacaccatcataaagtcgacaaatcttaagtcaaatcatcgttaaatctgggactatctctctctgtaggattcggtactatctgcagttttagacatccaccagggatcttggaacacatcccccatgtatatactgtacagaatttcaggtttgcaggagacaagagttctggagattgtttgcacatcaatatgagtaaacataacatcactgaactatatacttaaaaatggttaggatgaggccaagtgtggtggctcacgcctgtaatcccagcactttgggaggccgaggtgagtggatcacctgaggtcaggagttcgagaccagcctggccaacatggtaaaaccccatctctactaaaaatacaaaaattagctgggcatggtggtgcatgtctgtaatcccagctactagggaggctgaggcaggagaatcacttgaacctgggaggcagaggttgcagcgagtcaagatcgcaccaccgcactccagcctgggtgacagagtgagactccatctcaaaaaaaaaaaaaaaaaacaagttaggatggtattttatattacgtgtatcataccactttttttttttttttctcaaaaagactgctctaaactgagagctcttgcagagcaaagaccacatcaggtacattcttgcggctggtgctggggaggagctcaacagatgtctgcccgcgacagctcagcaggtgggatgggtgatcggctgcctcccgctggctgtggctaacacttctagaagccctgcacaccggagagtaagcaaccagcccaagcctggctaaaaccaaaaacaataaaaagcctcgagaactgagaatgtggaggaggaagacaggacaaaaataaatccagtcactgctgtggtcaagaagaggtggctttcacccattcctcaaaggaacctcgaaagggaacgaaaggccccgatgttaattttagaaatagcttgaagccctgtccaacttgagagtgactctgtgcctcttccacagcttaaagtacctggactttttgacagttgtgctcctctgctgccaaatgaatgggggttgtaatccacttgaggatcttttaaacttcactgctgtttgtatgaatttggaaggaaaaaccaaacctcctctgagagctgactcacgtccctttgggcattgtgccaggccctcagaaatcacctcatctgccaacccatctataataccctgtctgtaaaagcatccttctgcttccactggccaggaagatcgcaaaggaaaccatgtaattgcaagaaaagccaagtcagagaggcaggtgacacgtgttttatgaccaatgaggggcaaagccatagaaagttcagaactgagagtgggtgggagcataaatcctgttgccattgtggtaaaaatgggtggcactcactgtgggaaccttgaaagggaacagagtgccacgatgctgctttgcagagggtcaggtggtcacacagcatcctggggtggtttattccctccgggtctcccccgtctgccatgttccaacaaccatcccagatcctcctccctctaattgggatcatattaaatagcctttccaccagtgacagaaggaggtgggctcttagtggagcccactctgtaaatatagagtaacaacaggaatcagaatgttccactggaaacaggtgggacttgtcctccccatacagactatagaagatgtttacaggactttctgcaaccatcctcatcaagtataatcccagaaaagtaacagcaagctgatgggtttattcaggtaatatccaggagacatatttctctttaaaaggaaaaggaatttgcatgttttgttatggccatcccttattccagtttaactggtccctaagaggctctaactacagcaagagggattttggttagagagattgtcaaaccttgaagaagggtagagacggaaagagagagaatttgagggaagattcctcccagggaaatgttttcaaaatgaaatctggacctattcatgtgggagagaatgcccaccccagaagcaggggattgacctatatgggctccgaagttcttttcatgctgtttccattgagctgccttcccttgcctgtgatgcaggcagaagtttgattttttttctatccctgaaggtgttggcaaaacagaaagtttctctccttcagccaggtctcaggcaacttctagtgtgtatttccccacccttttcatttcccagccagagaaaggggagttcctttagttgtggtcctcggttctgtaccaagagcaggaagctcctaaccccaaaccatcgcactcaggaatattctcaccacaaacacctagaagccaatctttccactccaaatggagatggacaggtcaatcagaaagaacgggctattgaaaagctgtaataaatcatgtgccaagtgaggtgtcagacatgcaaaccagggaatacaaagtcagagagttgtaaatgaagtagtgggttgaagagctagcagtggcctggttctctctgcccacagcaaaggcccagagccagcttgtgcaccacccctcctcttggccaggaaggtacccaaatgtctgttccttggtaagaggctgaccctgaaaagtttacacctggagtttcatccctgtatcttaaagcaaatggggtgatggggagggatgtcgggggcatgggagggtggcagaccccaatgcagcctagagacaaagccaccaggcttgggaattaacagactccatttaaaagttataaaccacctaaaaggattaccattaatgacagtgattaatgcaaactgcaaagtagcaataaatcattaattatactttcaatttttaaaaactccaacaaatcaatattaaatcttacagaacttattcactatgctggggactgttacccaactgttgtggggggaaaggcagaaatagaacacaaaaagcctgcagtgaaatacctctaagaatggctggagtagttaacttagcttgacttgacctcgttaacgtagttgactaagctgacttagtcaaggaatactaaagacctgcagttggaaacccgacctgccccagatctccaaagtcagtgtggaggcggattcattccagggtttgcacataatctgggtgggagagcatccgtcattccatcacactggatcctttcccccatgcatgcctttgttcctcactgatgcatccagccctcgaatgtgcacagcactgtcccagggctagaggttctgcctggtggtttcctgttgtgcgtagaatgtagacaaatcctcttcccaggaccaccaaggctgttgtgctcatctccttcttgacacacaatctttccgaatgctgttccctctgcctagaatgttcttcccttcactctatgtcaagttaatcctattcatcctctgactggatcaatctaggctccttggagtacttaccacagttgtaattttacagtcatttgtgcaattatctgactaatgtctggcctgttctgaggctataagctgcttgaggacagagaccatgtctgtttctatgtccatgttttccccagagcttgcccttaaacatagatgcttaataaacacttgatgaatgaaaaaatgaggcacacctcaaaggagctcaaggtcctggtgggagagactctctttggctctccatgtaaatgactccatcagccctctgctgcaagatcagtcttgcttgtgaagaactgagtcctctgatgggatcagggaccctctgagaggagaaaaaacttgcattatagagggtagactattgttatgctctttattatctttgactattgcctttctggtctccctttgaattagtagattattcagctgtcttgaggcccacaaggaacaggcattttggtccatggatcaaccatggaccaaaggtggacctctgtggagggctcattcacagaggtgcaggagcagcagtatgcctgaggctaggcattgtgcatggaggtggcactggagggaggaaggactttgagcccatctagaaagaatgctgggatcgattggttatgtctgttatggatgcagcatgggaacccagtagcgagcctgtcacacattgaccaggcatactctgaggaggcagggagctcgttttcactgacttcctagagagctctttttcatccaatccctgaggatgtctgctctgtgtaataaggggggctatttcttcacagttagttgtcatggctggatttcccatagctgggtggttccataagtagcctatacttagttactgagacaggcataaatttaggtctttcacatttacacggaaaattctctgaaacgagtcctgtgagagaatgacatcctaacgtgcccaggaaagcagagggaccaccatgcccgtcgcccagcccctgtggtctgtgacacttgtgcagccgctggctaaccaaaaactgaaggtctgggattagattgcctttgcgtaatctgggaagccaagtcccttttctgactggcttctgaagaaagaatctggtcacccattggtaggctgactgcgtgaaagaacgcactttgcaaacataagagcacacacaggggccaccccacaaagccacctctgcagtggtagtgtcgagtcccccacctactgatcacaacgtggtaaggcttctctgaaggttccaggaccatcaattcatgtctggaagtacggtggaagctgcacatcattcactgctgtgccacacattccctgagccacccttctgtcagatgctgtataaggcatggggactcaaagaggcacgggcctggaccaccctcatataactcagtaaatgagcagtgatgtaaacagaggaatatattgcatataagaggtgcagcaagagacgtctgtatgcatgaggctccgtgggggcactgaaagttggtgggggtgggtcagggaggacagctcaggcttaagagatgagaacagcacttggaaggaggagcagtacatgcagaggcccagagacgtggacctgtggggcacaggggactccagggtaatgggcacaggggactccaggttgactggcacagtgttccaggaggaaatggcacagatgtggccgcagagcagggcagggccaattctggagggctctatctgcccccctggggagtctagactgtattctaaggacaaggaggagcagccaaaagttttcagacaaggacaaggtccagtgtgtgtgtctgttggattcctcacagctgtgacgatgaggtgaggtggtgcagaaagggtgaggaggcagggtacaagttagaggcttccctaacagtccacataagacctggtgttgggggatgagtggaggtggcgaatactgcaatcgaaaggtaatttatgcccactggaaaataccttggaagatatacactcagcagtgacggagaaagagctcataaattcttattgccaggtccacatttctccaagagtctggcctcccaggaccattttcctggtctccactccagatctgaattcttgcccctcccctggtctccatagctctttgttattagtctgtcttctttgaattacagtccacagaatatcatctcccacccgtctgggaagaggttgagggcagagctggcattccacgtctctgtatttcccattggtgccaaacatacacacgcacgtacagacatgctttcatgcacacagagatgtctagatatcattttttattgggtaaaaaaaaaatttaggtgcagggactgcccaagttacaattcatctggctgcataggctcacggtgaactagttacaaatttgtggtttgggagacaagtcatgattcaaccgattcaaccgattgtgtccgtaaagcagctgggttcagaagtgtctgaagctgggggcccctgccgctgtcagcatgccagctcaccggtcgatgtgcacagcgaacgctggccaagctgtgcaaggcactccggtggcattggtcaataatggggcaggcaatgaggcagcgcccagaggataagacacatctttttttgattgtgtggcttgttttcttgaggaatgaaagggttttccaaatgaagatagtagaatggaaacaaatgcaaaaccagaaatgaaaaaggcgtttgggatctaggacttaaatgtatctaatcccggtgtgcttgtggacatgggggtgatctgcttggcttcatcagcagcctgcgacaactagtggcctacaaaaagctagccctgcgacagtgtcatctcactcccaatgaagccagtctccgaaggagaggagagggtaagaccatctagaatatccacctcgtccctccccctagaacaggagacagagacagcagtgaggctgggctcacaggtctggccttggggtcccttaatgctcatactaatggttaccatattacctgacattctgtagtaggttgtcctaatttctgtagataatcaaggatggtggaaaaaacctggacttcggagtcaggcagagtagggttcgaattctgactcctccactgactggctgtgtgattttgggcaagttaattaacctctctgagcctcactttcctgaggagataatactgtagtacatagcgaaaggaagtattaatagaaataaatctcacaataccaaagtaactttcagaggtcgcccttgaagctacaaccctaattcatttcttcctccatgaccccccatcactgccacattccgttctttgtctgcatctgaatttacacggacttatttgattgattccttgttattgcctgtccctgtgccttcccactagcctggaagctctatgagggcagggatcatatctgtcctgttcattagtgtgtccccagtgccaggaacagtgtaagcactctttcaatttttggtaaatgaattgaatgagaaacacaaagcttggcatatagcagatgctggaggaattctgatcagtgtgaccccagagacctagaaggaccagaggcgtggacacaggggtgtggctctgcctgagcaagtctctgtaacttgctgtgtggacttttaggtgtcttctctctctaggcctcagtttcctcatctgttcaataagaaggatggtctgatgatgatcactgaggccttctccagcactctctggctctaattgtcttggatcctccacatgggctctggactaaatagaacaggaaatccagctccatcactggagcctccatttgtaactttcagctccatgactgccatactaaatcatcccgagaggccagggtacaattcctgggacagggtagatattgcaaattgccagcagcaactggtagccccacttctccactcccccaacccttatggcccagccaccctcttggactcaccaagacacatctgttagcctcagacctggtttgaacaaacaggaagaaaggaaggacagaaaataggtgggcattgacctgtaccaggccctatgccaggtgctctgacacacagtgcttgcctggtcctctccatagctcaggaacatcattatccccattcacagatgaggagaaggtatattagttatacccatgaaggcagcaaatagcgaggcaggacattcgccaagccttctaactcaaagtctcacacattgaacaatttggtggagtttacaccctaggcctcttatctctgactattaatcaggctattcccaagtgtaatttatggcaagaatacactactaattcaggagcagcctctatgggagacattgtttacactaatgtagtaataagagcaaagaaaagagctgacatttcttaagggtaatggggaccacagtgacaaacacatcacaagcattctctggttttgtccccacaaaaactcaatgagtaggcactgacactgtacctactttgcagattaggggcacgagacttacagagtgtgtgaagttacacaactaagaagtggtggagccaaaattcaaatcctagtctctagttccaggccttccatcctaccacctcactatactgtgggcagactggtgagaccattgctatgaactaacagtcaattacacaacactgacacttattgcatttttttttttttttttttgagacagagtccactctgtcacccaggctggagtgcagtggcacaatcttggctcactgcaacctctgcctcttgggttcaagccattctcctgactcagcctcccaagtagctgggtttataggtatgcacaaccatgcctggctaatttttgtatttttagtagagatggggtttcaccatgttggccaggctggtctcgaactcctgacttcaagtgatctgcctgcctcagtctcccaaagtgctgggattacaggcatgtgccaccatgcctggcctaaagcacactttaaataatgatttatactaacacagttcttattatatgatcaaactgaaaggaaaagaggtcagtggtctccagtctcagccagcattaatgccaaatggattgggtcatactgtgggattaggtcacactgtcggattaggtcaagggctcaagatcactgtcactcattggatgaatgcacagcagtgccaggcatctccgtgttctagccagggcacctctagagattatccctgtgaactgtccaaagagcgtagccagagtctccagaaaacgagggcaggctgacccgcttttggagcccacagagactttcaacccataaagtgaagccaccagggttgtgtcccctcccctgcatagggtcatgtaggaatttgctggaaatgccctagagtgcagttgaaaaggcttagctcctactgaaagcaaggagagcctccactgcctccttcctgaatccgcaagtgccctggggtggggagacctgtgcccctacagcggacagccagctgatcgtggtctggagcttcttggtcagcatggtggcctcatcccacaagagatctggcagcagagcatgggacccaggaaaggtcactgagattagttctgtagctgagcatgaaactgactttgtgctggggcaactgcagctctgcatcccacgttgggaggcagccaccccaccttttgctgcctgcatggtcctgggcaggtcccttgacctggcagcacctcagctgcctcacctgtaaacggaggccacattcatccactcacatgcaggcgaagggtgtgacgtatgcatgggaaacagcctcgttgaactgtagattcctgaacgaatgtaagggagtttgattttcttattttggatcccaaagtcatcattgtcattgtgctgttgtgatgattcattggctgtgttcttacagaatgggacatataagcagctcacttggaaataaaggggagagcttgtcccagatcacagccacagtctggaatcatgagggccacctgcccctgcttgagaaggtgtaagtttcttccttcacccatccattctatcgcagatggatttccattgctttcccaccagggccaagctcctgtgctgatattggtacacggcggtggccccctagctttgctctgtcctcacagagctgttgctctaccacaggacacagataaggagtccagaattggctcagaggatctttctggcccaaaccctcacccaggagatgggtgctcagggccggtgattgttaagagatcccagtacagagctccgagctggccttgttataacctggtgaggatgctagacccacaggaaaagcagacaccaccccaccctgagaagactgacactggcacctcctacctgggcaccagttctgatgccagccagcctgagaaagtgacttcctgggggcccattaagcaggagttccttccctagactccaggcttcaccgggagatgcctgttaggaggaaacagattaggactgtatccatcaccaggtatggtacctcacgcctgtaatcccagcactttgggaggccaagtcaggcagatggcttgagctcacgagtttgagaccaggctgggcaacatagcaaaaccccatctctacaaaaaatacaaagattagccgggcatgattgtgcgcgcctgtagtcccagctgcttgggaagctgaagtcggaagatggcttgagcctgggaggtggaggttgcagtgagccaagatggtgccacttccctccaaccagaccttatcccccgctcaaaaagagaaagaaaaagattctatacaccaagctggccagtggactccagcctccgtcctcctttctttaggattctgggggagatgaggaaaggaggtgggggggagagcctcacccccaacacaggaggccgttcaattttacctggaaagccctgcttcttttctcactgtccccagctaaagggaaccatttatcccggcaaagtagaagaaggccgtttgcattctgaaatgaagcatcagcgtgcaatgacagttaaggtcccaagatacccccggagtcactttttattcttttctatccacaatcattaggggaaaatctctctgcagcttctgtaaaacccattcactagagggaaatagatcaatgagaaagccagagcccagagagcctgtgctggcggctctgaagcaagaacatccattcttccccaagagcctacgccaaaaggacaaaggatgctcgctcccaccccctgaaagaagagttagccaaaaaagttctttaactaggaatctatttcttatcctttattcagtaagaacaaaatctctttctgagagtgacatatcttacacttcaaacaagtgcaacttttgccacttatttttaagtgcgcttgcctgccaaagggatagcaggaatccagggggaggaagaggcaagatggtggaggcacagctgtttccatagctggcatctctagccaacagctgcaggacctggaagagcttgaagagctgacacccccggaggatgcacaaccccggagtgaaagactcggcctccggggctctgtttgctgatgtcagcaccaagtcggggcgcgccaggaacgctctcagcagtctgatgggagtgggcatgcaggcagcagaagaggaaggggccaacccacaagagcaagggaataagaacatggcctttgttcacttgtttcttgattggacaattattagcacttactgcatgcggggcactggcagtaggggtgagatgaaataataatagtaacaaaaacaatagcagctaccatactgaattcctaccctgtaccactgctttctgagcattatttcatgtaatgggcacagcaacccctttaggaaggtactgatattagatgaagaaactgaggcagagaggtttaaacaactagtccaacagctaataaaaggcagagctgggatttaaacgtggatctatttgactcttggctagagaaagacaaatggttgatgtgggcttactgagcttctcagtatgagcaaggcaccaaacctgcatggagctcaagccactaccccgcacccaggagctcactccagagccaggaaggaggggagtttgaaaaaacacagggagcaggggtgggtaagatctattctcaccccaggtgttcagtgacctcagggcagctggccaggggcagggcccaggaagtatggagcccagccctgctgtagagcctgatgtccaagctcaggggctcagcattatccagaaatcaccagatggtaagaaatcaccagtggtgaacagaggatgacctactcagtcatggtttaggaagaccaacagctgcagactaatatggataacccaagaatatgaggcaaaatacaatttctacactattaaagaaaaaaaaaagatccattcatcaaaaccctccagccagggctaggcatgagacttaaccccagggacctgaatgttcccacacagctccacctactaacatgggtgtgcatggagccccatccaagaggcagacccacacaggcccagtggcttcggcctgggtttcctctggctgtcactgttaggctcctttcctggccatattctccagctgcaccagcctttctacttagttgttctgcctggttggaggggagaggctctctgtctttgtgagggcccttttcacgccgtgcatgacaccttcccactctggcctctctcatagctcactgaggctgtgccaagtgccttatgttagggatggagcaattcaccatggagtcacctgggctgcagctgtatgtactggacttcagactgtggccaggctttgtgaagtggctcaaaaatgcccccaggccctagacaccaatgagcctgagggccctccttccctgcccagagtcctagtgactctggaagcctagaaacaaaaacagacatttctgaccactagcagggcacagggatgggttagcaaggctttcacgcaagccccaggctactgtaaacattttgccacaagcaacactgggctgcagatgaaaaaggccagcagtatggagcaggttgctccaacagaggcagtgacactctgagctataggtcagcagtgacacctgtcatttggggatgatctggtgtcattattagctcagtaagccctttataaataaacacgttcatcaacatctgtctgccttgagacagttgtttttcttcaaaacacaaaaactcacaagcccatcaaacatttgcctgccccactgtagtccccaggcagacatgagtttgcatccttcacgtggcatattttacagttagaaaccaaggagcgttgagtcctgtttttaagtgtgtttgaccaagagggaatgggaaacatgccagggtgtgatgtggccctgggcagtgtacagctgttcccacagctgacggagattcctacagttgcccgccacaccggccagcaagctgttaatctgagcgagagatgtgtgaccatttggctggaggggacaggaaggaggcatctgcccaggcagcaaccattctctctacagagcctcacacaccaaggattcacccctccctcctttcccactcacccatggccaccttaccacatgagcattcccagaggaacattttccaatccctgcctgtgtgggcttttaagaccccgtctccccgtgcaactctgcattttccttggatgtcccttttgattgctgtcattgctcccttgttggcatgacacgtcctcctttaccaccctctgcagtggactccagccgctctctgggatgcaccttgaaaggagggtagggctaggatttgaagagactggctgttttcttggagaaagccaccccgttcctctccctgtgaggggcatttgcagcaggaactgggatgccactgacacctttcagattaatgcgttcactcacaaacactaacacaattggctcgaattcacaactcatgaaatgagtctaaggggcttaacagggtgttacagcccacagcttcgcaaatgcggatggatggcaggacaaaacgcactaagagttttttattagtgcttagaattcatgatatgccttcacgaccatggtgaatccccacatcatgatgtccccatctttattattccacagcaacgtggttccaagtcaacactgtattatatcattaattagctgttcacctatttgactccttcccttctccttaccagccctctccctcccaagaccatgaactatttgaaggcagagaacacatcttattctttcccatcctggcactgagtagggaatcggtatctgctgaaattaactgaatcccacagatctcggtgaagacaagagtagtagcaatactggtaacatgagcaaatacatagtcctaatcccttttacatatatgaaagcattagttctcacaccaaccctaggtaacggctattctgatccctattttatagatgaggaaactgaggcacagaaagctagaatcgttcaccccaagctcagtcaggaactggcagggttcggctttgcacccaggcagtctggctccagagtcagacctccaaccctctgcacacactgcctttcaagctgaactgatgcagacaccgaaaacatagtgaattacattttcaaggaaagactctatagaaatatagcatatacaaagaggacattaaaacaattctattctgcagacagccatgcaagaggggcgtgagagatgccagaggagagaatatgccccatttcccatgggagggtcctctctacacatctaatgctgctcggcacacagtcagggttcgagtgaggcggtgaagaggaaacagggggacctgggcgttcagggaaaaggcccaaaaggtgggaggggtgtgttctgggcatggtctaatcagactatggacacaattgtcaggtagggggaatggctgtggccatgggttagttcagggcaatgattctcacattctgatgcactttcaaatcacctggggagcttggaaaaatcgcctctattcaatgcctcccctgagcaattgagcaattgagcaattaaatcagaatccctaggggtgggactcaggcaccagtattattttaaagctcccagggcaattacaaactactttttctcaatccaaatgtgagaagcactggttcagagtttatgcagtattattcaccagtctcttctctgcattatgaactaaaacggtgtgtggggattccaatgggtgggctcttttgatctctacttctcccgctgtggtcggctgtttggggccattctgtgggaatgagctttctctgggtttctagggggccctttagggtagtagtagacttcagattgtgcagctccagttcaaattccaaccttgccacttaccggctgtgtgactttgggtatgtgatctaataccctagcctcagtttcctcatctacaaatagaggattgtggtaggcagaataatggccccccaaaatgtctgtgtccaaatcaccagaacctgtgactatgttataagcaggaattaaggatgcagatagaattaaggccgctaatcagttgactttaaaatagggagattatcctggattatctagatgggcacaacataatgacagggatccttaaatatggaaaagagaagcaggagagtcagtgtcagagtgatgtgatgtgaggcttcctagagccccgtgatgtccgtgaacactgcacgaactagtgtttctacttccagactctattcatgagaaacaacaggaaatggggccgttgtggggtatgggtaggagaagtggaaggttgagaagggaggcccctagggagtgttcctggtcaccagctaagaagggaccgtggacattgtcagcaaggactttggagagttcatctcaaggtgttgggtaccccacctgctgccaagaacaggcaagagctgcaccactgtgcaccagcaaagggctggatttgcagtggtgatctccttagcaaggagagtccaaaattaaagtcaccgaagtctcttgtttgtgccaggccctggtgggccctttaacccagctctctcagctgatgctcacaacatcagcatgtggccagcattatgacctgtttatacagaggaggaaacagactcagggaaattcagtgatttgcccgaggtcacccattagacggcagcagagctgagattagaactcttgattctaaatctagaatcttccatgtcataccatatttcattttcttttcataaaggcctaattaatactgcagtcattattgattcaatcctgagagcatgagaacacagccagtacagactattaatctgcatttcctccttgagatgtgccagccataaaaaatgtagcagcttcaaaaactacaaactagaaaggggcctaaaggaaatttggtgcccaatgaataaatcttatgtcagctcaggattgttgtaattgcagttctgtataatgttcataaggcttgggtttcctgcggtccctgaaatcgaccagggaggtgaggaaggaagcagccattccccaccagggtgcccaaggactcccaccaaattagaatgtggtcccagccccgggaactaaatttatcctgaaaggacatttggatcagaatgttctctgctacaagagatcctgtccctcattgtcctcctctttctcttcttccagagccaggcagtattggctgtaaaactcagccctgtcaattcagcttgaaaaccacacatacacatgcagtcaacccgcagcaacagacaccacatgtttagatttgaaagatgggaaagactgaggcaagcaggaaaggagaggccgaggacatacagagaaggtgaaacaaggtggttttggtgaagctgagcgcagggtcaaagaggaactgagaagaggaaaaaatgtcccctggtggctgtggacaactcgagcccgtaacccaacagcagctggggcaagtcattccctctacagcgccagctgctccttcccaagccacgcagctcctcctacctgcccccgcacttcaaccttttgagcccacttaacactcagaagccccccgcacaaagtcggctttgggtgatgtcactgctgctgcgggtgacagccaggccctggggatagaagcctgctctgggatggtggcggtttccagccaccccaccaaacctgcaaggttgaattctgcaggcaaaggaaggatgtaaactccctgcctgggggagaagctaagtccccgaggctgctggagaagagtgtatttttaggcataggcttgatttgtgaacaataagggaagagcaaaattgtaaaatcctaaggttcttgtgaagtctgatcagtgtcgctcctgctaaacatccaaaaagatccgacagagcaagacaaactcgggctgccctcaagccctggctcctggttgggtggtgttcagtcagtgagatcagaacctcagcgttttggggtgggaggggtgtttttccattcctctgactcttaaacaagagtgtaccaggtggctctcatctttaatcctaacaatctcccaaggagggagattcatccaccattcctctagcccaaccctgtactctaaggtcagagcaggtcccagtgattgaggggggttcaacctgtaccataatctacacccgtctcccatccccattcttacctctcagtctttgatacagactattgacattctctccatcttacataaaatgctttgcaggtgcaacctgaagacaaattccctggcttccctctcccgccatcagatcgccatcccccaaccccttctcatagatagaatggggctactaccattttagacctgggtgcctcatcgctccagctgctgctcaccaggatctggctccagcccttctttctattctcacctttcaacattccctttacgatcagctgcatgcctcccattccgcagagccctgagcttctgcattcttcacagctgctggagctggtcccttcccctagaggaccctcgacccacctgcacctgctagaactgaccccatgaccatctcagatgccctgcacagcagcgtcctcattcccatctaggtggaactgtgcgccgtgccctccacacccttgtcctcagcaccagcagccaaggcgtgtgtgtctgcgtgcttatctctccattagatcacaagcctgtttagggcagggaccttgctgtccccacggtgcctggctcagaacagcccttcaatagctctgtgctgaatgaattaatcaccttttgtccagtcctcaggggagagaatagttgctatttctaacagcagcaggaagacaaatatcgccctgcccactcccccgcctcccattccacacatacacacccactggtggcaatttctctttgctctcaaatcgatatggtttctagcacattctagcaagaagcaccataaagagctgatagggaccttggagagcccttagcttcctccccagatgcacaagtgagggatctgagggcagtgaggggcagggtctgctggcgatcacacagcaggcaggtgtcgggcggctcccgcagagccgcctcgtggctctgagttcagaggcggtggctgctctgcgcccactggatggctccgccgtgtctggttactgatctctggtttgtggctgtgcctgatgtagtcacaggtcagtggtcatagccaggcccagctgctgtggctgagcagtgtctctgagaacgtccagccacggtggccatgcctcagcactctcctgtgacacaacgtgatctcaccgagtgaccaggtgtacggcttcacccgtccatttcacagactcaacactcagccccagcagccaagccccagcaccagcagccacgctttcatttcacagactgtgagtaacacgagaccgggtccagtctgtagttcacagctctgtcccataccaggcaccgtgcccctcacagagcatggctcaataaacacgtgttctatgaatgcagagcaggcttatttgggggctggggtgggagggcacataaaactacaacctcacaggaggccacaaaacttttaagatgaaaaagatttgcaaatccttgaagtttcttctttacttctcctgtctttagtccaaccaaagaaagtttacctcccagatttgacttctggttcgacatttgtatcaatggtttagatgaagctattatactcaggctcatcacatgtgggagggcaggaagctgggaggcccccaaatacatgttgctgagtgagatgctaaaaggcctggacagactagaatgaagggctgaaacagctgcagggaaacgtaacagaagaaaatgaaaggtacagttctcacctaaaaagccaacggtattaggaaggatgggagattgagggggcagagggtggggagctgcttagcagctcatgagaagacagaggggttttagtaaatattcaattcaatataaactaacaggctaccatgaaagctaaaagtcactggctgtctttggctgcagtaacaaagtgagaaagcaggtcggtgccttctgtactgacctgatcccagtggtgtgtaagggtcagtgtgtcaccagatccctgggctgctgtggaccaagcagatcctgttcagagtagcaagatcagggtggaaacaggattattgacatgattatggcagggaagtgggggcatttaatctagggaagtcctgggtccagcttaggggagtttgggtggaaggctgctggcaccttaccataggaacgggcagaaggaggggagaatatgggcggggaaacaggaagagctgctgaagcctgactcacccaggccactggcagcccaaggcacagtgtctaagggaaagaccagactcagcccaggcagatgatggcttggggttagaggcaggtctgatcctgagggcctggggactatcagggacactgtgactccaggcgagcagaagtagaagtcagcccctcagaaggcagggaggcaagaaagaacaagacccagtatggggctcagtgaggcttcaaggaagaccctagccttccttgggatcagaaggcaaggcagagaaactgaagcgggtcccagttctgatggctgggcaggttaccctgagatggctgcccttctacctccccaagggtgctgggcctcatccttgaggcaagccttggacccaaggggaggacaatagggaaaccaggagaaggaagggattttaataggcagaggagccaccacaaggcacagccaaggtgggggtgtggctgggatgagggcctccagagctgctgcaaggttggaccaacactgggttactgttcagccctaggcttcctaatattcacccttgttggagggaagtccccatgactcagcccaccttctaggctgcttctagccattgtaggaaccaggggtagaagagttaatttgaggacgggcctctctcccccaggcagggcaacctggctagctttggagatggtcaactcaaacagttgacctcaaaaccctctgccctcaccagccacatgactgtggacacatctcttaccttctctgcttcagttgctttatctataaagggggtatgaatacagagcctaactacgggactgtcgccaagaatcactgagatgataaagtaaaggcacagtctccagcacacaagagatcaacagatggaggcgacactattaccacctgtgggattaccaaccacttccccaatcgaaacttggaatcagaaccccggcccgtgacgttagggcgatgggacagggtaaaggtaagtttaggggctgacaaagtgggagatgcttgtggagatgatgtgcgaagagagctcaccacaagccttggtggaggcacacaaggccacacagaaaatgacaaaagtcagttctggagatggatggtggtgacaaatatacaataataaggatacaaatatatatataagaatataattagacaattaacgtcactgaaccatatacttaaaaatggttaaaatgctaaattataggttatgtatattttaccacaagtttaaaaagtgttttaaatgaacaagtctcaacttggacccaggtctacggaccgcaggctcagtgtctctcccaccatcatgctaacaggacaggtttgtatgggagatgcctttggaggaaacaaaactgctcaattgaattgcatcgaattctttaattcaaaggtaaatcggggcagttcatctcttttcctcgtccaattgttgggttttggagaatttgagcagtggtgattttgccattttttctcttaaaaacaggaaaatgtcattttactagatttgtactcaacaggaaactagaattatcagaattttcttgatagcacaatgcaacaacacttgtatagaagcctccaaacactaaagattcaacagtgccttccaactttacaaattctcagagagtcaatgatccttaccccaggagtcactgagtcctactatgcacagtgctcttcgttaggcacagcaggggtggctgcagggatgattgggaagacgctggcctccctgagcttaattgagtgccatgtttcttaataagagtgtgcactggcccccctgcggtgctgtcaaaacacacattcccaggcagtggggttcacctgcctatgcaggacccagatatgacacgggggatctgaggcacacccctgattgagaaccgctgccacgggggaaatgatcatcattgaaaaatggtaacaacaaaaccaaatagaacggattaactttgaaaaagtcagggatgacacaccttggcactctcagagaaacagaatattctttttttttctttttttttatactttaagttttagggtacatgtgcacaacgtgcaggtttgttacatatgtatacatgtgccatgttggtgtgctgcacccattaactcgtcatttacattaggtatatctcctaacgctatccctcccccatccccccaccccacaacaggccccggtgtgtgatgttccccttcctgtgtccatgtgttctcattgttcaatcccacctgtgagtgagaacatgcggtgtttggttttttgtccttgcgatagtttgctgagaatgatggagaaacagaatattctattaagctgagcacttgttccccatgactttggagaagtgggagtgcgcgttcatggaaggagtttggaatggattgttaaggcaggggacttggccacttactctattatcctgaaaactttaagctgtctgaccagctcctgtgtgtaagagactcaagaggagtcacctttaaactttaagatgttggagccaaagagctgtctttattattgttttctatgtcaagtttgaggctgtgtttaggggacagccagctctgtgactgggcagaggcaaggctattaagagaagggacagaagttgttcggacagtcccacaaagggcctcctgaacacaaaccaggtcagtcattgttaccaaaaaccgctcacagccactctcccgacattttcctctccttgtcaggcagtgcccctcagacatggaattctggctacaatcagagttctcagagatcctctggcctaatctgcccactttacagacaacacaactgagattgagctagaacaagtagcttgtccaagctcacaagtgatcagcatcccagacaaactggccctggcctctcgtcccatgtagaatgggcagagggttgctggggtgggagccccttgggcagggcagttgttaggctgctttttttttttttttttttttttgaacattttcattctctcagctgcccatgctgggactgtgattttttgtatcctgagttacactggaagcttcctgagaagcgtgtccacggccccctcacttcacatggcctagggcgaggacaagtgtgtggtttccaaggtaacacatagctgggtggattcagcctcccgggccgcctcctcttcctgggaggcttcatcttaagcccgcaggggaggaggcgtgggaggccaggcgacgcaccgccttcccattcacaaacacggactcttcccgaaaccagtctcccctctgtcctcctgccagggttcaagggcagatgacccctccccaccccgtcctgaactcctggagctaaggaagctcctggaggacttggcaagaggcgtttgcctggaagtcaacagaaccccagctgacggggaggtcaagccttaacatgcccggagcagggcttttcacacctgttaatggacacagcaccacccagtgagagcatgatccaggatgacattccccagagacaaaacagaaagtcaatacaggcagccgagaaacaagccttgctgccaccacgagcacacccaccccatcggagacgccagccagggccagggagagcagccgggggccctcacacctgagggacagggagcaggggcaggaaagccccctctgaggcagaaagggttaagcccaagtgtttaaatgtttagcaaataaaaccaaaatgtcacacagagactgccagggctggtgtagtaaccatggcaatccatggccagcggccgatccaagtgaaaaggtgctgggatcgaggtgggcctcccagagagtggcagggagggccatggtgggcatggccagctcactgggcaacctgctgggacccgcagccccttaggatgcagaaagcacgggccagatgccaggtctgtgggcttcaggtcaggctctcagcctgttagaggctctactttctccttagaatgaggagggagtaaatctgccatgcctaccccagttttgtcattcattcattcatttattcagcctacactcattgaatagcacctactatgtgctaggcactctcatgcctttgggggtccaacagtgaaaccaatacagtccccactgccatggagcccacagtcagagaagggagttgcaggcaagaaatagtattcacaaccaacataagacacgcagggacaagtaagagccgctgctataagagctggtgctaggtccactcctagaaggggcaccctggggtcagggaagggggacgatggccagagagagttcctggaggaggaaatatctatgctgaaacctaaaaggcaaaaaggtgaaggcggccaggcccaaggcctcatagatgtgaaaaccctctaaaaaatacaaagcgctagacaagatgtggccacaccatcgtctctgaggcgcttgctaatgtatcagctctgagctttctgtcttcaaagtgtagtctgacgaggatttattccatggtgttctgacttctcgggcccagttggtggtgtagctcctctctctatttctccctttctttctagccccactgtgcacagctgggccaggcaggaggccgaggcccaaagaagagcagcgctccagtgaatccccatcaccagtcgctgttctctggaacacattccccattttcaatttcccttgtgtgctgtgatcatccaggggcacactcatgaaagtgggacaggagagggatgtaaacctggcagaggaggcccccatctggaatttccttgtcaaggtctcctccccttcagtacgagtggcccgagctccctccttccatctgctcatcacacctgagttaaggagctgacatgctcaaacctagccaggctgagaagtctgtctgggggtctcaagatctcggaggttcaatgaaggtatttctaattcatcaaccaaccagccagagacacccttaggaaacctctaccaggtgtctgaagaaggatggggactctagcccctacctggggggtttgggcagcctccacctcccttcggaggacaggcacagcttccttctctttttttttcctctcctgaaacgctctgggccagctttgtcctgagcatacaaggtctctgctcctggcgaatgcagggcacagcatcatctccgcgtgaaacctgcccagcctctctgggagaaatgcatcactccctcctccgtggccacttggtgtttcacagaccctcatattatggcacttatgaccctgggtcacagtggataaaggtctaggacaaaccaatttccaaaggcaggaatcaggtctgctttatttctggattctcaatgcctagcacaaagtagtcctacaataaatgtttgttgaataagtaaacgaatgaatggactcaccatttttatagactgtactagggttggaaaatttagagaggtcagtacgtgctctgctattataccttgtctctcagtgccaggacaccttacaggttacattcaggatgtgacttgagcctgctttcttttacagggagaagggagggtgagggcacagagcaagacgcaacgtgagttgtcctgtctgttctttcaggggaagacaccactaactcatttagcggtgggaccccaaagcacctgggccagcaacacctcctgcattacagacacccatgtccctgtgacagcacattacacgcacccaggaggacactcccatccacagagcaattatgccacaggaagtgaggcttcctataatttatgtcctgtaatttcaagtaatttccctgtctgctcagaactctattggtatttaatgaaaatatccacttttatatacctaataaattaaaagcctcccctttttttggtcccttgtatttcaaattcatgaggttgaaggcccatagtttgttactaccgttacgtttctgttgagtttgaaaaagactggaaacatctgagaccaacgctagatcttgaggggattgatatccccaggcaagagtggatctccaccccattgatctgattgatgccttttactttgaatatggccaagaaccacaatttgaaattaatgatctctgaagctcccattctgggactggattatatgaactctgccactgctctgtatcccatcctgggtcacagtagtctcttcagtttaattcaataaacattcactgactacctgctacgtgcccggcattggcctggatgtagggacggcacctcccatccctgcaactttattaaggatgccaggctctgctccacgcctccggatgtgaatgtgtctgcaccccaccccttattccatgcctggggctctgagccaggcacttcctcccaggggtactggatccctcccatcctcccttcctcactcctgccccagctctgggcatcaacacccctcacctggcccatgatgacgtgcttcccactgtcctcctgcctctgaaattggcctttcctatatttgcatgctgcagatgaagagtgctgtctaaaatgtaaatctgatcatctctgtccccagcttgaaaccttctcatagtttctgctgctgcctacaggacattccaaaacccttcagcaaggcaaacaagtccctacgggtccttcccaccctccatagtgaacttgcccctctacccaggaccctgtccttgagacattcccagtgtgctctgcagttccccatctcagagcctttgtttactctgagacctctgtctggggtatcctttccactctgtcagccagacaaacacattcttacttaagctaaggagttctgcatatattatctaatttaatctgtacaataaccctttctggtaggtactggttccgggtgggtaggcatattcaaacctacccccaaaggctgaggaagctgaaaggctgaagaaaggggctgacatatccagtttctcagaaagaagcatttaatagggacttatgaacaaaagccacagtctctggcagcagtaagacaagatggtggatcctgcaccacgaccccctagtcccagggattaaataccagaggaaaggggtatatgtgcttcagaagcaatttgcctaagggcaggacttacagtaaacagtagataaaggagaaatcttagaggctttcccgaaactgggttaatcggaagtcaatatggaggatcagcatccaagatggagttgctgtggcctccacagtatggttattagtcctattttacagaaaggaaatagactaagaaggattaagtaacttgctaaaggccacctacacactaaatgtgacaaacagcatgatttgcgccaagctgggctgctctgaagtctacattctcagtagagaacgttcctcaagcctgggtcataactgagttttatgattctgcctgctagcctgccttccaggatggcaccagggccattcattagagccatagattcactcaaggctgatgacccctgggagaagcaatggtgaattctgagtttctcatctagagaactgggctcctgtcctgggctctgcacctagaagaacattattaaatagatgctgaaccaatgactgcacttggtgggtcatcaagggcaaaggaggagaggatactggggagcaagaggagttcagtgttttgtgtgtggagccaggggctgccggtggcatgtaaaacgtgagcctgcagcctggggaggggattagcacggtctgagagctgttggtgagagctaaaccacagaagtaaatggactctccaagggagagcatggttttcagtcagagttttggtaaataaacaaaatgcattgcttcttgtgttttcatttctctcccggacacactggcctgaggaaaagaggtgcctgagtctttgaaaggtccgtgctccaaaacgccaacagagagggagactgaggagagatggggtggggtgccatcttccaacaatggaggctaccatgcgggaaaccaaccccttcttttccctgctccagaagcagaaccaggccagggggcaagttccagggaggctgcctcttctcggcagaagggcgggctttctaaagacattggtagggcagcctctcccaggggggccagcagctccgtcacagtagcacacacagaggccctggggttcctgcactaggtggacactacagtttaaacgtgtcccctccaaaattcagatgttgccaatgtggtagtgccaagagatggggcctttcagagatgttgaggccatgagggctcctcccttgtgaatgggattgaggcctgtatcaaagaggccccatgcagtgttcagtccctcagcctcctgccttccctgcctgaggatgcagcaacgtagcgccgtcttggaagcagagagcagccctcaccagacaactgaagctgctggcaccctaatcttggacttcccgatctccagaactgtgagaaatacatttatgttccttataaattacccagcttgggtgagagttacccaacagtgttttagaattcttcttcctgaaaaactcaagccatctaaatgaacaagtaagaatactgttctaaaaggtactcccccagcctcacatgtgtgctgggcagggcctgggtcctgggtgtgagcttctggggcaaggctggggaagacggggacatgatcatctggtccctgctaaaatttagctaggtgatcaggaaccactgtggatgaggaaagctgtgagcagattcctagcaaaggtcctgacatcacccaaaggggagatgcggcagccaccccctgccctgcctgcttcgcaacaggtgagcagcagctggcctttgcctgtggaagggtgcttgctaagcactcccctctgcataacttcatcagtcacacttgggataactccttcctccactcgcaggaagcaggttccgcagctggctgagcagccagatctaaatcagagaattacaagattggggggctaagtaatagatgaggaaactgaggcccgagaccaaaaagctaagtcaaggtacgaccagctttggaaaagagttaccttgaactcagcatgctttccattcaaagaacgtgctacaaacgtgctatactctgccgagaagagtatactgtcagacactataagtctctggacatgcaaagattaatgcaaagataactgtccctgaggtagggaagaaagacacccaacagaaaactacaatatggcccagtgcggtatatacaagggcgctccgtaggaacctccctcccactgactctctgggcccaaactgttcccatttccctctggcaagagaaggtctagctgggcacagaaagaactttactggaaaggtaagaggcacagaggaagccggttttggtgactttcctcaagtgacggaggctgcagggaggataaggggctgggtggtgggagctcagggtacaggcagggctgggccagagcaggaggaagcccagccacctgccagtaccaggcagtcgtgatagtgaccacctggtggacccagctggtaagtgcaaggcccagctagaagcagtgggacaaaggtcacaggaaagggaccaaagtttccattctgtgaaagcccactctgtactctacactgtttccaacccctgcaagagttcagcaaagtgggtgatgtggttcccatacttcagatggggaaactgagccccagagtcaggattcaacacaactgatttcactttgtttctccaaattgtgtcaggccaaaatgaatgacccccaatagcatcatctactgcccatgattagggctgaaacagagattggccatgagctggacatgggacaatgggtacccagccaggttctgggctgtcagcaacatgaccctgccaccaggccggaactgagtcaagctgcagctggaccagaacaggctgagagctagggctgcaggccctggactgggaacaaggacctcaggagcatcagagggagggacacctggctctacccaccccaatgcctggagcagaaagaggaagtaatcaggcctagcaccaccaaagtgtggggttgaggctgagaacagctcctcttcttccccttcctcaagcctgggtcataactgagttttatggttctgccttttttctttgttgtgtgtgacacctccccacacaggtcagggtgacacatagtaatacagtctccctacagatgagaacatgaacactgagggactgcctggatcccgcggctggctttgggtggggtggaaccaggcccggagcccagactgtcaacttctgtcctgtctcgattccgtggccctagtcctccctgcctgtactcctggctcctttctggggctgactggacaatggtctgagttaaagtccaccactctgtccaattcagactccatgaaggaagctgcctggtggcatctggcacaggcacagcccctgtccaagcatctgcaaccctttagaggctgaagagtcccagcatccaggtcagtatcctctagtcattgacagaatgcagccctgccaaggtggcctggagccaaggcttccatgtcccagccagccacagtggcccctgaccttcagacaaaaagccaaggctctctaagaggaggaggcactcccacctgcgtccgcactgctgctccaccctgaaaatgccgagtaacaaatgggactggatttgaacggtgttgttaaatagcgcttcacaaagcactctcccatgcgctcctcatcccatcctcacaacagctcagcagagctggaataaaggccccatgttctagatgagaagatcgagacccaggaaggtcacagggctggccaaagacacaccaagaaaaaaggtcatggccgagacttgaccccagtttttctgactctgagctctggtcttcgtcaatctctcgcctgctgcccagatgtgaatctatctgtgctcctccagccaaaggaccgggatggtttccagattcacatgcacatgaggaaaaacatctggatagtttagaacttctcaggtccacagcagtgcaggtcagcctgaagggccgggggctgggggaagctcattgtcaccagaagatgcttcagatctgttctctcctgtctgaccctcctggcccgggttgaaccatcctccctatgtcagccaaactggaagtgcaccctggaggcccagccaatgtttctctgggtaccaagtcactcctgggcagcaagaaacagaggccttctcggccacagcagactcttactctgtctagaaaatgacacccccagcctagacccacaagggtgaagaccacaccattcacaaaaagcagactccttggtggagtttggtgcagcatatgtgggggtacacaaggcaggtctgcctcactgaagggatgaactgagtggcccaagttcagaaaggacaagagacacaaaaggcagagcaatgcatcaggggctctcccggtccgatggtgctcagtgagggtcccgaatacggcagcctcgctcaacatgaagccctatgtttgcctctgggatccccactttgaagacaacttaacagttattcgaaagccacagggcggcctcgcagtttcctctcccatttgggtccaaaccagaagagaagagccacgatcttgggcaccgtcttgtaaaatcacccaagtagctgctaagggagtgggttttgggggtggggatgggctcggctcagagcaaggccaaaggatcagccgctgcatgaaggggtgaggtgggggcacctacctggacttcacgtgtgtggtaggcgatgatcaagcccaaaaggatgatggtggacagactgataaggcatttcagggccaacgaaaacatggagtcctgcaggaacaatggagagagagaattagggagtgcggggaaaggagcgtctcactttattctgcggctgtgtaaaagagaaggggtggggacacaggagggactgttaccagcccctcctaggagcaggtgtagcacaaagtcagcctgagccccacaaaagccttgggctgtgcccgggccggctctgtctcagcagctgccccctttgagcctctgttttctcgggctaagtcgtatttgcattcctgggatgaacgctacttgggcatgatgtattatgtttgttatacacggctagattcagtttgctgatgtgttatttagaatttgtgcttccatgctcataactcatatgaacgtcattctttgttgtgccgctattacatggtttgggcatcaatattacgccagcttgggcctctgttttctcttaaacccaaaccagaggatttcggaggcagaattctttcaggaatgaatttgaatgtcccggcagctgctctcatctcctggcttaggccaagggcaggggagggaggcagggacggcagaggagctactggagagagaagccaggaagcacaggagcagagaggggtcctggcaggagaagtaccctgatggtccctcctgctagggattaggtgggggaggtgagccccgtggcctccactgcagcctttcagtcccagggcagcttagagaaaccgagaagtgtggttaagggcatgacctccggggccagactgctgggtcccagccctgcgacagccatttagggctacctgaccttggaacgcccactccacctctctgcaccagcatgcctcctgtgtcagatggagataatattctggactacctcacagggctgttgtgaaaataaaggagttaatgtatgcaaagtgcccagaacagtgcctggccaagtaagtgttaactacccttatcatttactttgcatcctctacaaatcagggtgtctgggttggaacttggtgcacctctgggcatttcgaagctggaagtagagatagctcctagttccaaaggaaggcgggaacacagccctgagcaaaggcagcagatgagatccaggaagcatttccaagcagtgactgtgtgtatggcggccctgcacttggtcctgagtggtgcacgccacaaaagaaacattcccttcctcagggagctggtcattagaagaatgatgcctgatttctggaaggcaccttacagtttacaaggtggtttcacgtatttgttctcatccatcctcacaacagccctcggccttttaccttatagatattacaggctgaggcccagaggagggtgggtggcttgtgccagaattcaaagtcaaggcctctgactcgcagtacagagcactgcccacaagccctcaggcacactctccaatgggaaacaacttagaaacatgggaagcatccatttaaatagacctaaatgacatcttaagacaacaaggtaaggtagagtatgatcaattgccagagtgaaacctacagtagagctaggggagctcaaaggagggaggccactgtggatgggtcagagacagctttcagaggcagatgtgaggagcagctgagatctgtggggtgaggcggtatgtccaatatggcaaccacaagaatgagaggagggcttgggactcgaacccaggacttccaagtgcccaggtccatgctctcggccccactctgtgtgctgagatggaatgaaagtgctctccctgatgtctattaatctccccattcatttaattggtacagttcttgaggcccactggagatacaaagaaaactaataaagtaactaattcattcactctttcacaaaaatttcaaccacttctcatttgctgagcacttgctagatatccaacagtgtgctagattctatatatacagtgatatacaccagaagcttctgatctggcttattcactaactctgactttctacattgcatggggtcgtccaactatgggaaaaggtctccattatttgctatgcataagatgatctacacataagccagtcttcttttagcctcttcatgttccacagttccataagagcagcctgcaatcatttactcagcacacatgtatgggggcctaaggagggctggtgctgttctggtccaacataagcacagagaaggacagaacacagtgctggccctcaaaaatattttgatcttcacaagcacttcctggtgcctgaaatgctacccaaccacaagacccagatggggctgaaaagagcaaatggtgaattcaggaacactcagactgtattagggtaaaacaaacctccctacatcaatcaactggggatcaactggggacagctcacaatgttttccatccagaaatgaccataactttcttttcaaaggggtctgaaagcatctgggagcatcacacctccccgggaaggatttgggatcagctgcacatttcagccccttatttatttcttttggcagcaatgaattgacatcagaatccaagtctatttccatcattttaaaggaagcagtgaagggaaaggggccagatgctctctcctttgggcctcttccttttgtcctaaagctcaaaacctttacatgaacaggcaactcccacctgcttcttggttttggccagtacaacctccctggccagctccagccctgtgggatgaccaagctgtgtgctggatcaacagggactctcgatatcttacagatttctttgcattctccatcgcatgtcaataaaaaaaattaaccaaccgcttttaatagctggaaaacatgtcaaagaagtctggctgaactaggaatgttttctatttggtaaaatgttgaattagcatcttctctttgctgcctgaacatcagtgaagcttgaaattgatatggttccttgggggatggcagtgacaccgggctgccatacatcccaggatagggtacctgccacacgcattgcccccactcactcctatctgaggaccaataaggggcttgtagaacagagggaatccagcggtcaactggtcaacccttctgccccgtgactcagaacttttcaacacagagtaacaatccttaacacacaggaatgcttaggaattatatcccatttgatgagaatcatttttttttttttttttttgagacagagtcttgctctgtctcccagactggagtgcagtggcacgatctcagctcactgcaagctctgcctgccgggttcatgccattctcctgcctcagtctccccagcagctgggactacaggcgcccgccactacacccggctaatttttttgtatttttagtagagatggggtttcaccgtgttagccaggatggtctcgatctcctggcctcaagtgatccacccgcctcggcctcccaaagtgctgggattacaggcgtgagccaccgcgcccagctgagagtcatgttttaaagtcatttattcctaaatgcccacaaattttcaagtggttaagtagatttgagatcaggcagtgatggaacactacgcagccactaaaaacacttctgcacacggccgtaatcccagcactttgggaggccgaggtgggcagatcacgaggtcaggagatcgagaccatcctggctaacacagtgaaacctcatctctactaaaaacacaaaaaattagcgggacgtggtggcaggcgcctgtagtcccagctactcgggagactgaggcaggagaacggcatgaacccgggaggcggagcttgcagtgagccgagacagtgccactgcactccagcctgggtgaagagcgagactccatcttaaaaaaaaacaaaaacaaaaacaaaaacaaaaacaaaaacaaaaaaaaccaaaaaacacttctgcagacaatatctgaagacatggagaatggttgatgatagactattaagtgataaactcagaccccaaaacgatatgtagtatatttccaattatttcatttttaagcttttttagtgtagaaaaagactgaaaatatgtcaatagaattcctaagagctgcctccatccatgtggtccctgttctgctccaggccacgagccagcccttcacagatctgtgatttctcattgatgacaataatctgtaataaagcacatctataggggcctaccatgcaaggatggcattgtcaacccactcttacagaggagaaagcttaagctctcagaagttaggtaacttgtccaagggcatgttacctaacttctcaccatggcaaagccaggatttgcaaaagccaggttttacacccagatctgtctgcctccaggttccattgccccgcctgtgtcccagcaccccacctgctctggcggccacgccttgctggccctccaatatctgcagcgaggcttcttagagctgttccagcctttcctcccctgaggctgtgcagagggtgatggagtgtgttccccagcttctgagccagccacataaattgctctcctggcctgccttgtagcttccaaaaacaggccagaactgtaatgattatggtatatcttcccagagactttgaagttctaaatgtattttattgtttgggtcatcgcaaaaaggagaaagctatgcttacagacagagacctggaggggcactgaaccaaactgaaatattagcttaactgagataatgatgcgcaggctccttccccaaccaagctgttacccacaaagagtatatgtgtatggttgtgtgtgtgtgtgtttatacacatatgtggtccattcacgatttctgtcactggctgaaacccccaaagggaaaaggtgatagtatctgaagttcataatttctgaattaaggtctgatgtgcctgcctgacatcactatgttttgtgcattcaatctgggaaataattgatttagaaatcttttctatctaataaggtcaacttttccttcaatttcatggagaggctccaaaattgattgatattcaacatcggcttatgactgtggttctgtaatggttgtcctaattagatactcttgctaattaatgctatgcaaattaaaccagcccctcttccgctaaagggaagaccgcatcactggtcgctgttctccatggagacctgaggcttctttccctccacatcagcaccaagccctggccttcctcattcctcaatctcacactgtccagttcttgggatctttcattcttacccatcatcctcagctcctatcttagcacagcctcctcctcccaggtgcagcaccctaatttaattgcaagcccaggcgtggtggctcacgcctgtaagtccaacactttgggaggccaaggcaggtggatcacttgaggtcgggagctcaagaccggcctggccatcatggtgaaaccccatctctactaaaaatacaaaaattagctgggcatggtggtgcaagcctgtagtctcagcttctcaggaggctgaggcaggagaatggcttgaacccaggaggcagaagttgcagtgaaccgagatcacaccactgcactccagcctgggagacagagcaagactctgtctcaataataataataataataacaacaacaataataataataattgcagctgttggccctcccagcatcctcagagcggcttcccaacctggctcctaccagaagtcagctaacagaatcctgtttcagtcactaatgaatgaagtgacagaatgaagtcactcagaccctctctctcccaggactgtccaacctgagaccgggagagacagccgatgctgtcacagtgggaagggagactctggggactccagagggcagctggacctctgaccagcctgagaagggagaagggcctgatacttgctagccaagacagctctggaacagaggcccagggtgtgcatccgagggcgcaggagtctcagcctcctccatagtgaatgcctggcctggacaagttgcttccttctcctaagcctcagcccccagtaaaatgagactcctggacagaaccttctccgaagttcagttaagcctgatgaccaaggcgccgagcacacatgccatgacaaacaggtcatagggacatgtccaacactcattcctttttttttttttcttaggagttttcttttcccaggcatttctgtgatgaaatgttgggtgtgaaacggtcagccacaaaacccactcacaccatcttctcctcaaacacaacaaggcaagcttcctatttttagtcatgggggggctaacgaagatgttccttgtctctttctaaataacataggatttgaaaccaaaaggccagagttcaagtcatgtctttgctactaactagctgtgtgacactggatcggtcctttaacctctctgggcctctggtttcttctctgcaaacaagaactacccttacttttctcacagctgttaggggatgagatgagatcatgcatacgaaaaatctcattctgttttcacacaaagagaagcatgcattcccttgtagtcaaacaccccttctcttgccatacagatgtcagtgcaggtaaatgcagctgatcctcagtccggagctgctcactgcacccccaatatcagcattttatggctgcaataatttataaagatatccctgaggcatttcagaaagacacctttgcaatccgcatagccaaacattcattcacttgtgcattcatacaacatatattcactgagcacttaccatgcccaggcactgtgctgggcaattgccaaatgccagggattccccacccgctccaaccccaacctgctgagcctgaatcccatccaggagctcccaggagctcatcccaagggctgccctctgcaccatcatcgccccgtcaccttgacatcccatcctgtccctcttggacactctccctggcctctctgtcctgcccacagtgcaaggtcaagaagagatgggccaagggtcaggtcagggggccctggaggacacatcaggctgggacagccaggaatgggcaggaagcccaggctgagggagaaaacccacaagtggttcctttgcgctcgagtgaccagctctctccacggcagagctcaagaatggatattagaggccaagctccaggaacctttcctgcctgcctgagcccactgtgtgggtgaggacatctttaccacaggtcccaggggctggagatggggctaaacctcactgccaccttttctccagcccagtcaccttcttacatgaagcttctgttctgggcccacccctcaaccccacagccaggggatgcttgaggtggatccccagtgggcggaaagctgagacaagaccatccacactctcctctcagtcccaggagccagccaggcatcatgagccagctgacccgcatcaggatgcggggtctgacctagacccgagagcaggtggctcctcagagccctgtcttcagtcctcctgtgccctcctcagcccccatccctgaacggggtccatatacccaccatcgaagctgggagccattacctgctttaatagtacacagggtaacctcagcaccaggaaccccgctggtctgccctgggccccacacccttcccgaggctggccatgcctggtgtctcccattggcactgcccagctggggtgaccagagcacctttcaccatctgaccccattttcccactgatgttgttctcacacccccaccagagtgtcaaccccagagggcagggaatttttacattgcatttgttcactcctagagccccatgcctagaacactggtctggcacatagtaagtcaataaatattagttgaacgttgaatatttgaaggaagggagcaaaatttttgagatatgtcaagcaggtagacacttccatcctgaatttccaaattcatcaaaactaaagagaggtgatgaaagtaacagctaacatttattattcacttaccagaggccaggtactgtgctaatttcgttaggtcctcagaacaacccatggccccattctagagatgagggatctgaagcctggagagggtcacattcccaccgtccctggatgaggaagaggtgggggctagattcaaacctgtgctctcaccactgatccagagggaacctcaggaagacaggatggcaattgccagaacatcacccttgcaggccctgcccttaccggtcccacctgctctctgaagaagcccccagttgtgtggctttagtggtgtgatagatggtgaacagactgagctcagggcttggggtcttcaccgtctctgcagactgggcccggcacggggaaactaggcagataatacttgtggcgtgaaggaagccagtggtctcgacacaaaactcataaagtcaagttgccctggagcatttccctggatctctacgttgccactcccagaaggagacggaacctgatgtctgagggacatcatgcagttaataacaagggcattcaggtctgagcagagggtggcctactaatttttagtgaagccagcatgatgaccaggacaccaattaagagaaaatgatcctccccaggccctggctctcccattgtgtgatgtcccaaggaaggcagaaaaaggtcatttaggagaccacgctcccaaaatatcaagtcagacggggcaccccttcaggccacaaacataattccaattaaggagatggtttcctttataaggtctgggcagaggggaactggcatatcatgaattctctactgcatgcttgcttataatttattttcctgccccacttacaatattggcaaagattccatgcgattcaatcaaactttttattacatgtttgccatgtgccaggcactgtgcgggaggtggaaacatacaggatgaggcctttttaaaggcagtttggtccttgctgctcctaaggtagccaaaagctggcccacctaggattcttgcagacacaaagcaagcacttaacaagtgtttcttgggtaaatgaatatggaacggtaaatacagacttaaacctttgggctccatacaaaggcagaatgggagcagaagggtttgtaactccccacccctacagggaggatggaggtgggatggaagcccatcaagcaccaatagcccgggtccttgtagaactgaggggcttggcaccaccccagagcaattaaattggaatctctgcaagtgaggtctctgcactaacttttaaaaaaagatctcagtgaatctaatgtgcgggccagaaatgagaattgctgttctggggcacaaagaaagaagccaggaggctggggttgccctcacagctctgagacactgtgaaacagacagtcatacacacaagcaatggagcttagaagccatctagttcagtgccccatgagtctcctaagatttctggcacatggccatccagtctctgcttgattttctccaggggttggaaactcacttcctctcaatgtagccctggagagactctattttggatggctctttttcaaagatctgcctgcagtgcttggtcccagtgaaacaaatgcctctgtgaagacctgctctgactttagcatcccggtgtctatgtcaatgactttgacaagtgagcctctccctgggacacacactcattaacgtacagaacaccaggagatcagctagttccccaaccctcattctccacgatgacactgaggctgccttgcccccatcatacagcatcctggcttggagaaaactttagaacccaggtgttggggctcccggcctatgcttacaggggcaggcagcccggcccaccctgcttttcatactaacggaaatataacaaccggtccctgaattcatctgttctccaaaagcctgtatccctatcctggaagtcacctccaagactgtcacttagtcactgtttccttctccaataaaaaaatgggctcctgatgagcttttagcctcctctgcttgtggaatgtgagtgctcttggccagttagcaattacattactcttgtggtgtcaagaagtccctacagcctcctctggctttgatgaatgcgtacctgccactatgcatcaggttctgaaggtcctgacaccatacctttatctcaggagaactgtatagcatactgaaggttcctagtcccagcccccagatctgtcctggcatccagggtgtacagagttacagtgaaacacttaacctttattcaccctcctagcgcctcccagaacgctggtcaatttgccatcaccatgaggggttcacctagcaaatatttactgctccacctgccaaggatctggcccccatatttcatccagattgcaggaacccccattttcttaaatgttctagaatatttgaaacaaataattgtgctttctggatggcttgctttgaagtagttttgctttctcttagtaaaacctatctggctcccaaatgaataaaacagcaggaaatcactttgctctacagaaagctgtgggctccctgttagactgggttgctgactagaaccaaaccagcctagctgggcttgtcccaggcctgggcttccctttccccatcctgccccagccatcgctgacaagacgcacaacagattcccagattctctgcaggagctgtggtcagctaattacagggaactggctacattcatttcagatggctataacttgaaataatgttgattttcatcacctgatagccacagagaggtatgtgggttttaaagacacaaagcaaggcctacagacaactccccaccctgggtctctcagccttatcacccctccaattggccttccccctttcctccctccagcccttgcctctgtctgcaccagaagctgctgcaacactagggccccagctgaaccttccaacttcgtcagagaattccaaaatggagaaaaccactactacccacctgatgctcagaggcaaacccatttccatccccacactgggcaaaatcatcccccaaccccggcaatgtttgggccaaatgaaaatttttaagacacccagaaatcacatatggtgagaaaaacaaccgcctgcaggctccacagacatctctggaggctgttctggagtttcccagataaagaacagcctcgtccgtgtttcccagccatgcttccaggcttcccggagttgccagcattctgagggcagcatcaccttccttccatttccacacccacggccttgccaacaaacgtgagacagtgagtcctccacccaacactcgacttagctggaagaggccttctaagccatcaagtctgactccccgattctataggcaagcaaattaaggcccagagagggactctggcctacccaaggccacacaccagtaacagaaagggctgataatgccctaagccttccaagggtggggctggtgttctgccacatcctcactctgcccatccaccagcttgaacactgtctgaaagggacaggcccctgtcttagtcctctctccacccctctgcagctactcaattcaggtttggggagtgaacatttcctccatgcctcattcaaggacaaatcaggagaaacaataattacctactccaggttctctatcttcttttggcttaacaatacaaaagcttaaacataaataaagggaaatggtctggaaaaataaaaaccagttggcatggaactattggcatctcagtgcggcataagaagtagaaatgctgtttttcagaaacagcacagccgtgagtttcctaacatttggcacaggtttttcaattgtttggatgtgatggacgatgttgatagaagtggtggagaccaaacacaggctattaatagaccaaacatggcacttgtataattctttctctctctcactagctctctggcaccagactgctgccaacctgcctaccttttactttgaggtgccatgaattccagcaatggggcacgacacgagccccactgcctgcccatgtccaagcatgttcatctgagagcctggaggaaggctggaagccacacaccaacgtgggccaccagcctgtacagggcttcaaggaaactgcaagatgcaaagactccttgggtgctggtcctgcctatcacggggcatgcagtagagtctcccaagtagactatccatggtctagggggggtcagggaacctcccaattcctccatgtggttatttcctccatttctttctccaagaacatgaggcagccccatctcaaggcgggagctcattccacactaattgattcaagttagagccatttcaaggcagaaggatctccatggttcccctacaggtgttgcctctaggaactctccacagattcaaactctacaaggacttactgagtacctgttatatgacaggctctgagtctacccatccatcttcatataaactctcacttaatcctcacaggaaggaactgtccccacttgacaaatgagaaactgaggcacggaatgattatacaatttgccaagatcacacagctgaactgtgggagccagacttgaaacacacagcttctgattccaagcccaggattggtaaggaccgcagcacagtcccggctgagacctacaccctgagctcttcacggaggaggtcgcttgttcctgctccactgaagccagatttgctacttctttccccctgagctgcacttgtttccacatccccagaactcccggtcctgaccagctgtcctctacctgcatggggtcagccaccgaggaagccaggccaaagactagagctggaccgtttgacaccatcaccatctttaacatctattcaatgagactaaaaaatcctttcttccttccagggttgttgtgaggaagagcagataatgaacgtgaaaatactctcccagtcgagggttcccacgggcttaaaacagcctatgcagagggtggcgatacattcgggtttacccaggagagtccagtgtatgcctgttatctggcataattattactatgaatggtaatcattaatataataatctcaaaagtgtcccagtttagacaatgaatcatatgatcaccctatatatgtagtatttgctgccaaagggtctgagagaattggggcccccttcccgccctctgcccccacacctgccagcttccacacccactatgtgcactccattagcagacactttgccaggctcatgggcagacatcattctgctggatcaaagcaattgttagtagacagtatttttagcaaggtggtgtcacagtgcctggattaattgcaattaattatatgtcactcctttaaggtttatttcatcaattatggacaatcacggccatgtgccttgcttgctttaacccttggtgacttgaatttcttggcacagaggaggctgtaaccatggaaaaggctgaatatcagaatatatttgctactgagtcactgtgtcctggatgtcagtttagggctttcctgtttacaaagcattttcttgcacagtttcctatttgatgctgggaggtagagaggaccactcctaacccacagatggaaaaactaaggctgggaggatttaagcaattacccaaagccatacagttaggaaaccccactcttctaacacagggttgccaaaacatttccaagtcttctgtatagactgatgagtgtgaccctctggcatcagtggtcagatagccccatggccaggcatggggacaggatctgagggcgtctggaggcagacttgccagggaggagccaaaggcacctgacgcatgtctgccaggcagagcagcccttaccttgagcatttcaagtggccctaatgtcaagaaactccaagaagaatgtgtccgtgccagaaaaatatgcaaacaaggacacccagcaccttccttctttgagtgttgagcagccggaagagcagccagaaggtacctcgtacaagtgaggagatggtaggactcccacagtacccctgggtccctcttgctgttgtaataggaggagccagaggaacaccccacctgatactcgactggccttaatttgggctcctgccccccgtctattttgccctgcaccggttacagaatattagttctaaacagatctctgagctcccctagtccaaagcctcgttttacagatggagagactgagaccccaagcagggaatgccccatctccgaccccacttgccagggcagagctgagcagggacgtgggcctcccctcctgtgggttcttgctgactgtggctgggagtctcagctgggaactggggtgctgtctggagcgtttctctcacgggaaagtttgctgcgtcttttcttccatccctctttcttacctccacccttgtctcactctcctcacccacatttcatccctctcgcactattcctgttttccgggaccaggctttaagattgtcagctaaaggggctaggtctgaaggaaactcggctggagcccgagagccgccgcccctgggctccctctgagtggcccctccaggctcagggctgcttcatggcacagtcggggtcctttctgtctctctgctccatcacctcacagaggacttggcacacagtaggcactcaataaatacttgatgaatgaatgaagggatgctaccctatggcctgttcccaagaagaggagaatcgtgcaaaatcacttccctgcaggccccatcatctaggtggggaacaacacttccaattgtggggagaactccatcaacttttgtttcctcgttccactgactaaacagatacttatttgcttagaacccattgtttaagcctttttttttttttgagacagagtcttgctctgttgctgggctggagtgcagtggcacaatctcagctcactgcaatctctgcctcccagattcaagcaattcccctgcctcagcctcctgaatagctgggattacaggcgcacgccaccaccatgcccggctagttttttgtttgtttgtttgtttttcattttttgtgtttttcttttttttgcattttagtagaaacagagtttgaccatgttggccaggatggtctcgatctcctgagctcgtaatccacccgcctcggcctcccaatgtgctgggattacaggcatgagccaccgcgcccagcctatctacatgtaacagctgtgatcaaagacctaggaaaacagccaacccagccaactcctcctcctggttcctcaccctggaggagctctgggcccgagagcacagaagctaggaaggcagcagaacgagtgatgcttatgggggaaaacctggctttccacccacagctgtttcaaggcgtcctgcagaagtgggtctgggggtccctgggcaggaagagccagtctggggctcccaggcatccactgccggtgatgacacactgagctatcaaagcttgggtcagagcaaaggaaaaagctcacaccagccaaatgcacagacatctcacagatgtcacgggctaccaggtggcaaccccgaagcagctgcctcttgtcacgtgggggccaggtgggtggggattttggcccaagggggtgaactgtctcactgaagagacacagctgggcccagccagggctgtgtgccgtggggagccaggtgtgctgaggtcagcggggaggaaggcgctctcgcagggctggaagaggagaagccaggcaggcctgaattacgagggcaggagtgcacatgcttcctggaggactcacccctctccctccagctgccaccagctgctgaccacggtgggacagccagctgacaggggtcaggcggccagaggtggatggacaagtacagaacagagagtgtgggggccaaacaggaaggcggccacgggtgtggagaacgtcagggctaagacagaccttagagtctttgcatcttacaggtcaggaccctgaggcctcgacttggccaaagtcacccagctgctagatccagatctagaatttagagctagagcctagctccttcccctactcccgggctccttctgctataccatgtagattccatagcaagtaatttaagacacaaatcgtgccatcccactccttaaatcccttctgcggctccccacagcctctgggatgaaggcagaccccctaagcaaggcatgatctgacccctgcctgcctctacagccccatatctcatactcacaccataaattctagccataccgagttgctcacactccttcaaaatgcactaagctttcgtttccctcaacctttccatgtgcttgctgggccgggaacaacctccctgccttagcctttcccgttcccagtcaaccttcaggaccggctccgttctcgccactcccaccaccctaccctccagagctgcctccgcctctgcgcttcctccaccctgtcccttcaggcctcttcgggagacaattctaagtgcgttgagcatctgcttaccaggctgtgagctctttgagtgtgggaaccaagtctttgtcatctttctgtttctcccccacccccagcaccttgcacagtgcctggaatgtgagaaaaactccattaatgtttgtggaattaattatcaaattaaggagtgaatgaagcctgggcagctttgacagtaccttgtttctcccgaagctactttacctacagaagggccagtgccactcaggacatctctaaccgctgatctgccttctgctctccctccctccccatgttggagggcagtcgggtcactccatgggaaaaacagcaactgagatacaggggacccaagtaacacccccagttgtggtgctgacacaggtcgctgtgtagcgatggcaaagcagctgagatggtgactgagttcacttatccatgaaatgagtgcataaccacgtgcccaccaccatcgagtgacctgcgatctgcagacctcaggaagcagggcgcagttgtgctccctccacccccatcactgctccaaggctctgcgtacctacaccagaaggggaacagatcccatagcccaaaggagcactgagcctccaggagaccctttggaggctctggtaatgtgattttagagaccatctgtcttccaaattctgttttccctgtacaaaatacaaacaagatacgacacctgatttacatcccctaagcaccaccagctgatagggaggaaaggtccccatgcagtgagacagcagcagggacgaacgtgacctgggtttggaaaagacactacaggcaatccacaaagtggataatccacacctggctgacgaaggtttggcccaggcacagagagtgctccacagtgagtgagggttgctggactcagacccccgctcagctctcactcgacaaggctgaggacctcgcctggggcagactcggccacagagcatctgagcctttctaaagcagtcctcagccacccccaagagcccttctgggggccctggccactggccactggtggaagtgttttgaatgatggagcgcagagacaaacacagacgggacaaggtgccaggagccacataccagagctgcttctcagagctgcaaatggctctcagatgacaccccagctgctagctccttgccaggggcagggtgggcagagaggcctgcagagcaggggctaggtcacagagctggggggaggggcacagggagtcagggatttctaagactcagactgggaacctagcaggaaaggcactggaaattgtacttactccatttggtttgtctatttgtctcttgcaatttatctagtatttcctaaaaggtcactgggtggtgatttcaataatgtaaaatttgtagagatgctctaaaagaaatgtacaaatttcacaggtttacactggcttaaaagcaatatattttattaaaagtgtctattctaagtgcactttggataggatttggagactgattggttagagattcaaaaggccttgtgctattaaaagatccactgtgtttttggggtggtaaaaagaaatagaaatcaaagcatttgcaaaggtatggttggtggatggagaaaaagcggcgtgtgagatcacaaaatcctttgtcacctcacagtccccgaagcagggagctgggaaagaaagatgcttattacaagcagagggccaggtttcctgcgaaggcttccgtgtcccaaaatctcacaagccgcttctcactttcctctcaccgctcctcattaactgaagccaatccttgtcattcaaaggaaaataaacagggagcaactgcctgcagagacaaagagtcctcatatcgggacaaaacggcttctccaagcagacaccttttccctcagccccagtcagaattctctatttctttccaaacagcagagccatttccttcctgtcagcccagtgatgcacaacttcctgtcaggacagctgaggaatctggagaaatgtgtcttccctcacagcctctgctcaggtttgcagggcctcagacagtaccagggagcagagtggagagctccaaagaagcagcccctcccacgcctctgcccccaccaacgccctccccggatcccccaggtcaggccaccgaatccagactgagtgtgtgcaccgcaccctgccatcttaggcttctgtctcccagaagcctttgtgggaaccagcatttccattcccaaagccaccaggtggagaccaggggcaggcctgcccctgcggggtcaggccccgacctaatcaggaccctggggcctgtcagaaagactgaggcctgccctagggctgcagagatggtgagggcgcaagggagggtcttttccgggtaaagatgggccgctgacagcccccttaggtcagcactctggcaaacccactgtggtataaaaataaaaacctcagtcccacagactccacattaaatggagtgagaggcagggagatgaacactgaaataatcacctccatttagtaagcgctctccacgtgtctgcattcttcctttaatccccaacaaaccctgggacagtggttcccaaactttgcggcacattagtatcacccagggagctttttaaaatccccacacccaggttgcacctcagggcagtgacatcaggtcagaagctgggagccaggcatcagcatttttttaaagatccccaggggattccaaaatgaagccaagttaggggaccactgagcaaggcactgttcgtacctgttttattaataaggagattgaaactcagagaggttaagtcgcttgcctaaagccacacagcttctaagcaatagaattaggcttctggttcatgcctgttattccatcacagagcccccctcactccaaactttctgcagaaagttgttcagctctatctaccaggtattgtctccctactacatccccatccccgaatgagagcacctgcagacatctttgcttgctagcaggagtaaggatgagatgtgcgagccgaaggggctgtgcagggctggggagagcgggctgagtgtgtgcagatggcctattgggaggtcatgggatcggcaggttctgctccttcctcatctgacaatgccatttaagttctctccagagcaaagccttggcctggcctaagaggatggccaggtgtgaaggaaacgcacgcgagagtgtagccacgtgggtgagcgagggcacgacagaggtggtgaggatggcacacagcctggagagggcgagcccagggtaaggggtgaggggagacccccgggagtgctccaaaccagaaccttgggggattgacccacttcttgctgcctgtgtgacttgcagcaaatcacttccagtcactgggcctcagatcccctctttgccctgcaatggggtgggaccctatggtccagagggttctcccaccctggcctccacagtgatcatggcggcccccttcttgggtgtgagcaggtgcgggtgtgggagcagctgtggcctcatcccaggcagggtccacacacagttcaggcacccacagagccctggctctcagagctgtctggccaagacagggaggccagtgcacctattgaacatacaggccgaggagaggggccctggggcagcaccccacacttgaccttcctgagtgtcccagccatgacctcctgagcttcacatcacctggtcgcaccccaaaagtggggcagaagggggctataagcaactgggatttaaagcccctacccctcaccccagcccactgacctgcagcctccactggctgcttccctaagtgccagacagaatctggtttccctcctgtggctcattcagggaccccccccccgccaccacctcctctgtgagctttccccggccctccctgacataattaaatgctcagtgctacttctgtgcctggttccaacctctccccttgcatatattacactacactgtgctcaccatctgtttacactgctgttaccatcagggcctcaagggaagagtccggtttgactcaacagaggcagcaaagcatcacggtctgcagaaggggctttggagtccgaagacctcacttagagccccactttgccacttcctcgccatgtgaccaagcctcaacttactcatctataaaatggggcagtaagagtagtgacctcataaagttgtcatacacattacatgagatgacacgtgtaaataagtggcttagcgaaggacctgacacttataataggagctcaataaatgacagctatgagtgccttcatatctctgacacctagggcctagcacaagcccagcccatagacatagatgctgaagaagtatgttgaaataagctgaaccccagcctgtttgtagccttgacggtctgcttggcctctccaggagctagatatggtccctgcccctcccacctcccaaccagggctggctccctgcatccatccaccctgcagaacagttcccctccccagaacaagaagctgccccatccaggttctagacaaaaaagccagctgcctggctctccacagctggttcccagcgtcccttcagcttgagagcccacatccccgggcttccaggcagcacccactgagctcaagcctcaagtatcctcagtcccagcctcagccctcatcaaatattttttttaatagagatggggtctggctatgttgtcctggcctcaagcaagtctcccacctcggcctcccaaagtgcagggattacaagtgtgagccactgcgcccggcccctcatcaaatctgaagtcccaaggttagcgagtatgcagggaggctgggagagaaaagcaagaggccccttacagcagaggctgaaaccttttaaagcaacagtgagaaacgctgagagagaaaccaggcggggtaggtggggagttctctcccggagactccttctcacccttgcttcccacagaacccaagaaaaaggcacttggcaatagttacaattccagacggcacttaacgaagtccaatgcctcagcaagacagacgtttggagaaataatgacccaggggactttcagggaaggctgtctggacatggaggggcggctgtgagatttaatgaagccagttctacacaagagtccagcacagggtgcggtgcccctgcctcggtgactgccccgaaagtaggagggggggctgcacagccaggccacaaagggcagacaccaggccagcaggggaaggccaaagaacacaccctcgggaccagcaggggcttgcagaaggggactccacccaagggagcaaatgaatgtcccccgttacacacagatctgggcagacgccctcaccctcactccttcccctccccaaccctcctccagcccctccattatgcaaatcaagtgactacacagatttgcataattcatgcattattagtacgcgttcttgtcaggcttttagactttataaagcaattttgctacctttaatggagagtaagagacaaggttctagagagagattttctgtccttctttcattagacatgaaaacagtctctaaatcttaagccagggagagagtcagacagaaatgaagtgacttagagttggaaacatgaccaaacacctcgttgacacttggtgtcaaaggcctgggtgccgggcatcgcgccggtcacacatcctgtcaggcctctcaggcactcagaccatggagtagtccccagtggggcagacgttattattgggaagtcactccaggttcctgggagactcagtaacaacaaaacccccactctgggtttgtatcgcttttttatattttacaaagggctttcgctctgctatcttactcagcgcccacaataaggctatcgggttggaagggccacatttttaccctcattttagacatgaggaaactagggggccagttgcagtggctcatgcctgtaatcccagcactttgggaggctgaggcgggtggatcacctgaggtcaggagttcaagaccagcctgaccaacatagtgaaaccccgcctctactaaaaacacaaaaattagctgggcatggtggcgggcacctgtagtctcagctacttgggaagctgaggtgggaagatggcttgagcccaggaggtggaggttgcagtgaactgaaattgtgccactgccctccagcctaggcaacacagccagaccccgtctcaaaaaacaaaaaaaagagagagaaaaaaaactggggccactcacctaagatcaaatctaggctctctgtattttttccactacaccagggatggcaaaccccttgccactcttccatttcccctgcccaagatagacctcatgaatcaatcagggcactcttcccattgagctcagacaacacctcagaatccttcccaacacagccctcctggaagctggtaccaattgtttcaacttgacacccagataaaacctatttgctgttcctgcactgtatcctgccaactcctcagcatccagccaacactgtgacagtgccaccagtttctgggaagtgcctgtgggctaagcttagcctggctgctcagccccaggagccccagacagccaccatcagccagctcaccggctccaaatggaaccagatgcacctgcatttgggagcagatcagggagagtgactcctacacccccgggcccaagaggtctctgcttttctcactgcgggggccccactacccaggaccactgaggccaccttgactaatgcacacctgcttcccacacagcaggagccaaaggtgtctgcttctgcaacggacgcagcattgctgtgtggcatggggccctgcaaggggttcagtcagggaaggggccacatgaccagaccacccccgcaaacacacacacacacttccctagggccgtgccccagccagtcccaagggcacacgtccttcccttgtacacatgcggagcctcctcctctagacagatccttctgcatgggccccttccacaaccctgcaaggaaacttgtttagtaaataatagtaataaaaccctaaaagtgctcattttgatcctcacgcacatgcttgttgtccaggctagagaaatgtgaatcctgccttccccaacgccctaccagcccccaagcccatagggcagccctggctcctttcctacccttgtcaagaggccagtcccctttggaagatggcaagcagcctgccggtccaaaacagtggggtggcacagcacccacaccagccaacaccagctggcagcggctgccctggctggggggctttccttctggaacccatcagcgctggcttcctgccaggcccaagggagatgaagtacaccctcttcctgaccacgtctaaagggcctagacgatgcctctcccagccagaacccacagcagttacctccactctcttgccttacccttacttcacagtgtggcaccctccccttcctggtctcctgagccccaaatccatgctgctattgcaatcatcaatgggcttattctccaaatcatcgctggcttcttctgccaggccttgctgagttccttcctgatatttacagcccccgaggctcctttctggaggacgattaggcagcagcatactgagggggagccaggagcgtctgccccccgggaggaggagtgttttatcactgaccttgtttagaagtgccggtacacagcaataacaaaaaccagactttttgttggctttatttatttttctatatcctctacagacagtgtacccctcattgtctgcaccgggagccgattgctcccctgccccttggtaccctactgccattgggtgtctgcagccagtttccatggggctgggtcagatttcagatgaacgagtgaaagaatacacaaaattgagcagagaaagcactggctccagaagctccacttctcgctgtactccacagttggggtaatcaaggcctttggggactgccctctagggatttactgtgcttactagaggaggaatgaaggtttattcagcactctcaggccctggtgctgtgtatccatctagacctatcactatgttgtgaggtaggcattagagcggcccccaaggccaacctcccatcaccaccacccacacatggatgtgaccaaagcaggcaccggactcggagtcttcctgctagtaagcggcagagccaggagttgagccggctccgcctgacccctcacccccctccctgagccctgggctcctcccaggcctgcctccctgaatcctgtctgccccctcccctgcctgccctcacttgtccgccaagcatctaccagggcccctgtgtgccaggcacgtgctgctgctttcacatccctcatctcctggaaccctcctcactacccccccctgccctcggggagcctgcacatctctccaggccacaccgagagggaaggggcagagccagcgtgaatatcaggtcactggccccagatccagggctctttcctctctggagcctgagctgggccggcacccagctggatccctgggcagaggcccagccagccaatgggaaatgccatcacggaggaaggcaccgaggaccacggggagtcaccaatgacacaagcaaagccagaggctgggctggccatgctgacccaagaccccgctctcctgatgccacactggggttgcctgcagggaggctggtgtcttgaaaagttgactctgagatagatattatagtaagggtcatttatgtgaaccacatgattagaagtccctagatttcttctgaatatcctaggattttccccagcccctcaaagccaacacgcccaagatagaattcaccattccaactgcttcccaagtcttcaactcctttaaaggcaaggaggtcttgcctctccccacccatcaagtcaagtccatcatcatatcttgacaattaaaaacagaggccatttattgagctaagaacatgacacctgcgtaattacacctgtgtgatgcccttacagccacccgtgggccaagcatcataatgcccactttacaaacacagacactgaagttcagggagaccaggcaacttgcccaactgcacagccagtcactcccccagctccgacacgaacccgagagtagccggctccagcacgctgctgctgtcctccatacctactcctcccaaatctctgaaaacgagcaggaagagggtgtattccacctcctttgggcctggccagaagccagcgctgatgagttccagaaggaggcctccccccctccccagccagagtggctggtgccggctggtgtgggcaccgtgccatcctgttctctgggaccagaaggctgcctgatgctcgctgcttgtcattctccaagaaaaggctgggctttgagcagagcaatgtggcgagtgggccacgacagtcacttcgagcctcacacacaactcagatacccaggatggagaaaggtgaagcctgacaagctgcctgcctccccagacctccccccatatcttcccttcccactgccccgagctgggttcaagccttcattcctccttttcacaactatcgcagtaacactgcttccagcttcctctctctataacccatcctccatgctgtggctggagcacaccactgccctgctcacataccttccactgttccctgtgcctttagacaaaagtgcaaattcatcagcctagttcgtgaagcccccactactccaccagcttcacgggcagggggctccatgtccctctccagtcttctcttcccagaacttctaggaaaacctacctctccagccctccctaagaacacagggcactctccaactttgagcctctgcccctactgttgcctcggctcagaacacgcattcccttttgcctcatgaagccctaccttccttcaaaacccagctcaacccctacttcttctaagaagcctccaaacattaatatccgcggcaggcccttaacgggatgcagagcctctctaccgcacttagcacagtctgccttgcctcagagttacggcagcccgaacaccccctcagcctcatccatctctgtgtcccccaacgtccccggggccagtgcctgccacagaatgggcatcagtgaaagtttgccgagtagaatgttctcagagcttcaatatattggtacagacctttccccgacagcaaaccccatcttttcctggggctggtcctgagctcagaacaaatgtttgcttcccgaggtggccactggggaatcctggcccactcacctcaagaggattctagcgatgcctgggctggcacacttagctgtttctccccctgccaggaaatctgccactcaaccagctctgtctcccactcacacagcacagaaataatagccctgcattttcctgcaaattccatcttccccaaatggagactagctccacctgttcaaggaaacacaagcaagaagcaagatggagcaggcctgggagaacagccatgtggcctcgcaggggccaatgggggttcctgggcaatgccccccaaggctattattcagtgctggactagaaagcggattggcctgctgcctccctttgccggcacatcacagctgactaagcatgcttcccatccgggttcccactcagtccacaccacagccccattactgtgtagacaccactgccccactcaagacaagatttccaaggatgaaaagacatggagactagaaactaaggaaaaacttcactgaggcatgaggagtcaggacttgaattcaggtctgctgactcctggaccaggctgcttgatgacagaggcagcccccttgggaaagggtgagggaacgagaggacctggaagggcaggctgcagttagaaatgcaggctccattttcgcattcatcctcataacaagctggtgagaatgagtcatcgaaagcagggtttctcagcctcagtaccactgacattgtgggctgggtaattctttgttgtagggggcatccctggcctctccacattaaaggactataatatccctctcctgactgtgacaaccaaaaatgtctccaggcattgctaaaagtcccctgaggagcaaaagtgccccagttgagaagctctgatctaaaggcacagttagatcccaggtcttgtggtaagggaggggaccccccactgttctccctcactcccattctggcaggcgcttctttctcccctactcatgccactcgccaggcatccgcagcccataccagttctactgttccctctgcaccatctccctccactctaggggcagagccaggcggccccacaggcattccttatgttgggcatgtgtcaagtcaccggcctaagctccttcattaacatcacttcacaaaactcctccaaggcaggcaccatcaccccaatgaaacagataaactcaaagattaaatcactgaagtcctgcaaccaacaagggtcagggtccagctttgaaactaagtcagaaggcccatgtccagcaggcctgggctgcccaagtgaggtggccttggtctacaggtcccaagactctcaccctccaagcccgggtgccagcatcagacaccagctgggctaggagaggacctcaaaagccatacctgctgcctttccccactctcctcccagtcttaaaaagaacaggtgcagtggcttccctgtgtggtccgtgagagccctgggccctctgcaggctttggacatttggcgacatggttggtgcacatgaggctggtgattcccaacatccagtgcttaccttcccccagctgggagaccttgaggaggttattccacctctccaagctcattaatcccttcccccaacatccctgtggagttgaaagtgctagaaaattaggaatgcatatctttagcgttttgtatcatttcagtaagtttccataaaatcaggcttccaggccacactgggggagcttctgagcatttatgacacattttattcatcagcccagagcagggagatttgaccttgaaatgtggattgactcagaaagaccctagcaacttccagtgaccttcagggagtcaacacccacggtgctggaggcatggataacttagctgatttttgtttgtttgtttgtttgctttgtttgaggcagagtctcgctctgtcacccaggctggagtgcaatggcactatctcggctcaccacaacctccgccttcccgggttcaagcgattctcctgcctcagcctcccgagtagctgggactacaggcgtgcaccaccatgcccggctaatttttgtattttttgtagagacggggtttcaccatgttggccaggttggtctcaaactcctgacttcgtgatccacccgcctcggcctcccaaagtgctgggattacaggcgtgagccaccgtgcccggccaaattttttttaacgttgccagccatgcctcgaacagacctctggaaggtgagaggagccatctgttctgggtcaggagcccaggcagaagcttgccacggcctcaagcaccatcctgtgacctcttacaacccctggggcaggtgctacacgcattatatggaaattgatacacctcaaacttaacgagtccaaccacaaactccctgtcttcccccaaaaaactgcttctcccacagtcttctccattcaattaacagaaattccatccttccagttgcttgggccaaaagtctcagcctcatccttgacttcccctttctctcaccactgcctgacctgcacaccatgaccttttgtccaattcatcaggaatgccctccttttaaatagcccaagggtccagccactttttaccaactcaatgctaccacccaggtccaaaccatcaccaccctcacctgagctgtccccacagcctctcagcggggctccctgaccctggcttgaccctccctgtctgttccaaacactgcagtcagagtggtcccattaaaatgtaagtcagatcttgtcacttctctactccaagccctcctcttgctcccatctcacccagggtaaaggccacactcctcaggacggtctacaaatccctgcagagccagacccgcctcccctgtgacctcacaaccccgcccacatgatccctccactcactgaatcagcctcacaggcatcctctctgctcccaggcctgcaccgtccagtgtgaggacacgagccacgtgtgtccactgagcccctgcaacatgaccagtgcaactggattttaagtccatttcatttaaaattaaatataaaaagacactccactcttttattggaaaaattttaagtacgttttcaacaacttgagtgtgtgaatctattcttttttttttctcggacggggagtcagggtcttgctctgctgcccaggctggagtgcagaggcacacgcatggctcaccacagcctcaacagcaagctatcccccacctcaacctcccaagtagctagaaccacaggcatatgccacacacccagctaattttttttttttttttttttagagagatagagtctcactgtgttacattacccaggctggactcgaactcctggccttaagcaatccacctgcctctgcctcccaaagtgctgggattacaggtgtcagccaccatgcccagcaagtctgttcttttaattgtaaattttataaactctaaatacagatcaagtatctccaatgaaaacttaatgtctgattgagatatgctgtgtcagagacacaccagatttcaaagacttagtacaaaaaataaagtgtaaaagatctcaataattttttgtattgcttgcacattcaaataataatattctggctatgttgggttaaattaaaaatattattaacatgtataattctacttttctcttttcactatttttaatatggctactcaggaatttaaaatgacagcggtagctcccatttcgtgtccaccggacagtgctgtctacaacacaccaggcatgatcccccctcagggccttcaccttgctattcctcttcccccaggtggctggatccctcaccacttcagatcctccaatagacatcacctttttggtaaggccttccctgagcacttatttaatttatttatttatgtgtttatttttagagacagggtttcacatgtcacccaggctggagcacagtggcgtaatcacagctcactgcatcctcgaattcctgggcttacgggatcttcccaccccagccacccaagtagctaggactacaggtgcacaccaatgtactcagctttttttttttttctgtaaagatgagagtcttgccatgctgtcctggctggtctcaaactcctggcttcaagcaagcctcttgccttggcctcccaaagtgccaggataataggcgtgagctaccatgcctggccctaagcacttctttatttgttttatttgtggtttttgttttctgtttttgtttttgtttttgtttgagaccaggtctcactctattccccaggctggagtgcagtggcacgatcacagctcactacagctttgacctcctgggctcaagcgatcctcccacctcagactcccaagtagctgggaccacaggcacgcaccaccatgcccagctaattttttgttttgtttagaaggcgtctcactatatggcctaggctggtctcaaactcctgagctcaagcgatcctcctgcctcggcctctcaaagtgctagaattacaggcattagccactgcacctagctctgagcatttatttaaaatgaccactctcagccgggcatggtggctcatgcctgtaatcccagcactttgggagggcaaggcaggcagatcacttgaggtcaggggttcaagaccagcctgaccaacatgatgaaacccagtatctactaaaaatacaaaaattaactgggcatggtggtatgtgcctgcaatcccagctactcaggaggctgaggcaggagaatcacttgaatctgggaggcggaagttgcagtgagccgagatcacgccactgcactccagtctgggtgacagagtgagactccgtctcacaaaaaaaaagctgggcgcggtggcttatgcctataatcccagcatctcgggaggccaaggcaggcagatcatgaggtcaggagatcaagaccatcctggctaatatggtgaaaccccgtctctactaaaaatacaaaaaattagccaggtgttgtggcaggcacctgtggtcccagctactcgggaggctgaggcaggaggatagcgtgaacccgggaggcggagcttgcagtgagccgagattgggccactgaactccagcctgggcgacagagcaagactccatctcaaaaataataataataataaattaatttgaaaataaataaaataatatgaccactctcctctcagaagcccctgcactcccatccagagtggtcctaacaattgtgattgttattgatgatgacaatgatgaaaggaaaagagatgtctttttcctgttatctaactctggctgtaaaattagttggggccttaacagattgggatctaagacttgtcaatggagtaagaagttgtatcttggagggaagaggctcttcataacactcatcatagcacttatcaccatcgaacataatatataattaacttagatagtttactatcaggcttatctattaaaatgtaaattcgtgacagcaaagatttttctcttttgtgggttttttctactacagtcatgtgtcccataatgacatttcagtcaaggtcctgtacaattataatggagctgaaaaattcctatcacttcgtgacatcttgatgatcctgaacctgtgtcagcccaggctaacgtgtgtttgtgtctcagtttttaaccaaaaaagattttgtaagtaaaaatgcatctttttaaataaatatttctaaaatggaaaaaaacttatagagtaagaatataaagaaaatactttcgtgcaattgtataatgtgtttgtgttattacaaaagagtataaaaagcttataaagtgaaaaatttggccaagcgcagtggctcatgcctgtcatcccagcactttgagaggccaaggcgggtggatcacttgaggtcaggagtttgagactagcctagcctacatggagaaactttgtctctactaaaaatacaaaaattagccgggtgtgatggcacgtgcctataatcccaggtactcaggaggctgaggcaggagaattctttgaacctgggaggttgaagttgcagtgagccgagatcgtgccactgcactccagcctgggctacagagtgagactctgtctcaaaataaataaataaataaataaataaataaaattatagtaaggtaaggttaacttgttattgaagaaaaaaatattttaaataaatgtagttagcctaagtgaacagtgtttacaaagcctacactagtctacagtcatgtcctaggccctcacattcactctccactcactcactgactcacccacagcaacctccagtcctgcaagctccattcatggtaagtgccctatacaggtgtagtattttgtatccattgtacagtatttctactgtaccttttctatgtttagatacatacttgccattgtgttatgattgcctacagtattcaatacaggcctgggagcagtaggctacaccatacagcctcgtgtgcagaaggccatgccacctagtctgtgtaagtgcactgcatgatgctcacacaatgatgaaattgcctaatgacacatttcttagactgcgtccccgtcgttgcaacgcatgactgtatatctgtgatgcctagaacaatacactggcacataacaggcattcaataactttgtcaaatgaatgaaattatttttccgcctgggctggctactcagctggaagtttctaagtgtctagcatatggtaggtgcttgacagatgcctactgaatgtcaggctgatctgttagcagggtcattggggaaactgaggcagcttagctgagtgatcccacagagagcaaaagcaagcgccaagggtccttgagtcagacgtggtgcctcctcccgctgccacccatgctccctctccccgccctgagggaagctcccctgagcccaacagcctcaggtacctcggggaaaagtacatttcttttcctttccatagacttttattctcccagtgagaagacaaatctgtttcccctccaccagaaggcctcaagccacagctacttacattatagtaattaaatccctgctgctaggagggttcaggagacaagcaggactcgtgccaagggctggcctgcagggaggaggcagcagggagggaggctggccagaagggcctgtctctcagctgtctcctgagagtgagaaaatccccttagccacgatgtcttcacaggctttcgcttgtgggataggaagataacgccccccgcagcccaccctgccaacatgcaccatcgatgaggacccccgccagctggaatagcgtagctttcttccagttctctccgaaattccatctggtgctcacgaccttcccgcagatggccagtgcaggaaacatcccctcctcaggctccttctctcactctctagatgacaaaacagaggaccagaaactaagctgccccacacctagcctaggatgcttctcctcacctgcaactcagctggccttcacagagcgctccatgtgtgccagaaaccatgtcctctgccttacaaacagcaatatctcattaactctcatgacagccccagcggccaggttaggattcacccccatggaaactgtgaatcaaagcactgagacagcttcccaaagccacacagcctacagtaagtgacacagccagcgctgtacccaatatctgcttggcactaaagcctgttctcctaacaccaggctagatagcccatatagaagaatcagaggatggcctgggagacagatatgagggaggatggaagaagtgagggtgagatggaccttcaggaaatggggggaaggggagcagacggaggcgtgggacaccaagtctcaggcttgtgggtcaaacccaagccacatgtgtgtgcccttgtctctcgcaaagctcacatcagacctgttgttacttgttcagtgcctgcctcccccaccagcctgtgagctccatgtctatttggtgctgaacccccagaaccaaccagaacacgccaggcagtgcccttgtctcatttattcctcatgacacccattctcatgagagagagaaaacactgttaaccccattcacagacctggagactgaggctcaaagaggtcagttttctcaacaaggctgcacagccgagaagccacagagctgcggcaagaacactaggacgcatgctgttgagggctcgggtggcccctccagggcccacaggagactttcctcagccccagagcccagcacggcacctggagcttcagcaaacccctgtatctaaactgccagcatcctcctcccctcctccctctacccttaccccactccatgagcacaaaacatcccctgaggctctgggggaggctggcaggggactgagggtggcacagtaaggggtggggtgggcgggagtggagagctcaggcagggcaggagaagctttttggcttgaaagagcccagtctaggatctgatatgcaaaagcatgtctgctgcacaatgtgagggcgtcggagacactcccctgtgtgcaaatccaaactccaccacctcccagctgtgagaccctgagcaagtcacttaaactctcggagccttgggtctgtcatctgtaaaatggggagaattatatctacctcacagggttgttgtgaggacttaatgagatgaggtgtgtaaacacacatagtaggcccttaataaatattctcttctccaccgcctgtcacctcttcactcctgaataagacccggtgttgctttggagtcattcttacggaaggaaaaataagttcccatgtaatgagagcggtgccttcccccaagctgctgtggacacaggctttctttctatatgatcccgtccacccaccaggaaaccctcatgactcaactccatcctagacttgctctcagcttgcatcaatttcatttcactcttaagggatctttccatcgctggcacatagtgtgcaccccgtcaggtgtcttctgccaaaatgccctcccaccaggctcagcaccattactctcccagagcaggggaaagcatcttggcagagcttaacaccaggtccagcccagagcaggaggggctgggaaccatgggcccagctgtgagggaccttgcatgatcccaaggccactgagctctcagaagaaacaaccaaggtaaaacccaccattgcccagcatggacaagagccccctgggtgacagctctggcccacgttgaattcttcacctctccacccacaagaggaattaaaataccacctcccaaataaaggggccgctgcgcaaggccacacagccaaatagccaggatttgaatccaggtctatggggaaagcctgtgctctcttaggaagagttggtggagaacaacacatctggctggggagagacccccctggagtctgtaaggcacagattctctgcactcctgccgcctggagcagggcttgccacacagtgggtgttcaggatatgtttccagaagagggatgggagaaacaaaaagagaggaagaactaaaaccaggaattccaggattccagctatgcccctgccactaacaatgctgagtagcctcggacaagtcatgtaacttttttttttttttttttgagacaaggtgtcactatgttgcccaggctggtcttgaggtcctggactcaaccgatcctcccgcctcagcctcccaaagtgctggattacaggtgtgagccaccgcataacttctatgggccttggggtcctataaggaggaggatggtcctttccctgccttcctcacagggctgggaggcatatgcagggatcttgcccacccaggctagcacacctggctggcctacagagcttggccatctagggcaggtatggtgcccccctgaggaggcctcccctgcatcctccaccaatgccatccagctctgagccctccaaaggcggtggctcaaccctgagcaacatgcctaccccaagccctcaccttgggagaaggtaacatcacccatgcaggcagctccggccattcccatgtatgggagatttttggggagccaacatcttacccactggaagccagaaaagaaagaaaatagctaaactccaattcgttaaaatcagaaatctcaaaaggggttttgctctgcaaaaatcgctgctagtggaagcttgcgaggaggcaggctgatgccaactcaggcaaaggggctaggaggagccaccacttgctggcagcccaggagcacccacagccaggctggccacttgaccaaccactagcaagtgtcatcctccccaggttagtggatgtcagtctccccacatccattacaaacggggacactgaggctcggagagtttgaggcacagagcttaaggaaaaccaacggtggcagatggaccagaatgagcaagggcagcctctccctgcctccctgcagggccccctcagctcaaagccactgacaggtcagcaaggttcaatggctcaagccaggcaacaggtcatctgcttcctcctccctacctactgggtaacctgggcagggcacccacctttataggtctctccatctataacctgaagcaaaacaccaaacaactgtccttgcagatgtcgcgtggcaggcctggtatcagcaagctctaaggagtaggtgccagctcagtccctgcaaggagtgtcctttaagctgactttcctgttaatttgacactgagcagcactcctgtcctttaagaaaaatgcccaacaagctgactcaaaaataacagatgccaatttgcatattatttcacacatcatttgcatgctgttcatttagtatcatcaaggctctgctcagaatacaactctggttaccctgtgcccagggcttgtgaaacagatatggcttccacaaagggcaagccctgggcacgtccctcccctgcccagctgctcttgctgcctgccccctggcacctggctgggaacgtcacccactgccacagccctggtgctccaagcagggtgaaggggcagaaagaatctttagaattctaggaagcaccctgactcaagtcttgaaggggaaattgtgttctcttgacgacgcatcaggcaagctgtggcaatgcttttcttccctgcttctgtcccaggtcagcttcctagttcggctctccctgtggccctactctctcagcctttttctgcctggtcatcgtgtgtccccctgaccttcctccaggcctctcagcctctggcctggccccacgggtttatttttgttctctctccacctgtccgatttgcatgtccacacccggttagctctgcccagaccacaaattgctaactgagtgtagaataacagggccccatggggtaagaaggctccagaagtccagcccaggccaccactgcagccctgccctccggagaacagcccacttcctttttactcacacagattcacccaacaaggtctatccagaaacatgactggggagcttgtcacggacgggaagccatttggctcatgagaaaaggggcatgttccacacgtgctctccaggcagggacacctgcagacagtggaggggtgacatgggcgcatatgcccctcctgtcttgatgctccaggtggcatcttctaaccaccactctaataaaggcaacagttgccagctgctgagacccagtgtgtggctggctctgtggtggctgctgtgctacagccagtagttgtgattccctcttaacactgaggaaataggctttgggttcagtaagttcccagagcgcccatcactggtgtgccacccaagtttttttttttttttttttttgagatggagtctcactctgttgcccaggctggagtgcagtggcgcgatctcggctcactgcaacctccgcctcccgggttcaagcgattctccagcctcagcctcccaaggagctgggataacaggcgtgagccaccaggtccggctaattttcttatttttagtagagatgaggtttcgccatgttggccaggctggtctcgagctcctgacctcaggtgatccaccctccttggcctctcaaagtgctgcgattacaggtatgagccaccgcgcctggccccaagtccttaactaccaagcctggccacctctaaaaggaaggatatcaggtcttcggggcctgagtgtgcagaactctgcagccctggtggttactgatgctaccaaatattccatccatcactgtgccctcgccctgggcctgtgttcactgcctgcccaaagcctctccagacgagacagtctcctctttcctccctacatgcccctgtgtgcaccacacggcagcaacctgaagctgccctcatgcctgctctattccctacacactctgccccctctccccgggcttctcacactcagaattgagcccctgcccgagcccctcccatcatggcttgtctagtccttcagggaccccccaacctcctacagggaatccacccagcatccccagtctgagtcactgtctccttcctcagtcctcccaagcaccaacaccataaaccaccgtccgcctgggatggatgccatctgggtgctgtctgacacccctaagaacaggactctccggactgtggctgctcatcctcgtgatgaaacatgatctggaatcagattgcgaagcctcggcacaggaagggagttcagctcctgtttttaggccagagaaacgaggcccagagaggggaagggactcgacaaagatcacacaacaagctggaagcaagaggcagaagcacctcctgaggggctcaaagcagagacgggccttttctcggcactcactgcccatgacagagctcaacagaggcatgaggcacagacagggacgcaggaaaatgggactcaagaatgaaaaagaaacttctagaaccaggaatggagaagcccttcgaggtccctcactcaaatccccagcagaagtttgtggtggggtttggaatagggaaatcagaagtgtactgagacctgagctctcattctagaaccctctctttcctgagatgggcacctggagtgaggcactcaaccctgggaacccctgtgcagccgagttttctcatccctgagatagttggtcatcatgagccctgggccagccaccgtgagggtcatgagggacccaggggtgaaaatgccttgtaagatgtaagatgctgagctcatgtgactgtcccccgataaacagccacacagccagtgctggaggagaaaggcagcctaagagaagagcaaggtggaggtgaggggtgagagagttatgtatggacatgtccagtcaggtctaggggtcctgctggccctccaggggtggaaggtgggggtgctaggggctgtggaaggagcttttgcaggaagggctttcattttccctgtattctccacacctaccctcctcacaacctgcccggtatcaccctgagggcagcagcaccagaccccagagaggaggcatcaagaactgaccttgggccagtccacaatctcaccctgatcccaggccaacctggggtgcccacacttgccctggccacccctccagcactgtcttctccaggacctgcgccagcatctcccgccctccatcaagcccttcctgcccagctcgtggtaaagttcctcctgttccaacattttgcatcacgggtctcagtgccataaactcaatttttctcttttaaggatatgggcagcagcaggcaagggaaagggcatgaacttgggagctaaacgggcttgggttcttatctcagtgccaccaccgctggcagtgtcagtgtggcccggtgacttcatctacacagggggcggtgagcacgacctgctccttgtactcccgggtgtaatgtaaagccagcccagcactcagcaaatggtccttgccttcccctctcctgtcactcagcaacatcccggccagcccagcgaagtgctgggtgaccagaaagtagcgtggtccctgcccccagctgctcctcccctcctttccctcagatcccagctgagctcctgggggtggaatgacagggtcgggggagggggcacttaaaaacccattcgcctcctccggactttcctcacccgaagaaaaggcactagaattttcctccctacagctcctgggaaaagcacagtctcagaattccccaccctcattatttaaagaggaataggtgccttgctttcttgctctccttttggggttttgaaagaaagagaagaaaaagaactacaaatgaatgtgctggcctgcctgtcactgagctgagtaaagtggtatttcatcaatatacagccgcccctcacaacccccgcacacactcattttctcccccaaatgtgcttcacaaataactgcaacagagctgaagcgctctattctgatcttacatttccatccaggccccagattctctacagaggttactcaaatttcttttcattttgactttctttaccttatatttttttaaagcagatcttttgaccatggccttacaaatccctcttcctaaaagcacaataagagaaatacgaggcatcagccgcctttctacttaggctgtgcaggagataagtgccccagccaggatgcccctggcggagcacctgggtaatgccgcctgtggggaagggaagtccggatgtgtgatgaagtctttccccaggacagttataaatagtgtgatgacacgcaaaggagaagcatatataaaaagttagctgtccccctgtgggttacagatgtttgactcatttacagactgtccacaaagattataaataaagtcaccaccaccctggggcgggtggcggagaaggccattttcacgctgtcaaaaggccattttcacgcttgccctcctgtgggccgacacactcagtgtgacctgtgaagacaaaatgtgtgcctagggccctcggcagtgggctcgcaggctctcagccagtctcctgccttctgcatcctggtcctgcaggtcaccccacagggagggtccatggaaagggctggaaagggtctatcctactcctacttttccaccatggcctgaaacacaggcaccagtacccagaggcatcttctcaaaaataccaggacactgtgacagccaacaacctatcccaaagcagcacctgggtccaaacagaaggtgcagagccacttggctagccaagcctgcactgctgctctgcccttctgcagacaaggcttccgtgaccagggagagcagaggatcagaactggttccagtgatactactcaatcatttggtctagaggctggggatggactcagggacctctgtgaggtctgcaaagagacagacaagttggccttggccattctgtttaaagagtgaatggccagacgaccaggctcccctgggcatacggagaagcggcctcccatgaggttgtctgaagaaagagtaactagaagtgggaaaagaagacactgtgggagcagacagggcagcctggataagcatcttcacaccaactcctctctgccacctgggttaccccagcaacgaggccaggcaggggccacagagaggagcagaggggcaggaaatcagtggggcaggcgagacaggagcatggtgggggagtgggcagaggactggttctgcctgggaggagagatgcagaccagtttcaaggccgggcatggggaagtggcttgaggttgtacagattggtggaaaagaagagccatgctgccacaccagcactctccagcctcccctgagaagatcccacagcccaacgcctgagatcccgagaaacaaggcccctgggtgccttgccagccacacagaggtaccagctcagccaccaacatgatggcagggtcagggtggtgaagtcacagcctggggaaaggggagggcagccaggcctttcccttccctaattctttctgaacccagggaagagagcatacaggtaatttaatgcaatggagtgggtgtgccccaaaccagctctaaaagaaaataaagaacactaagaaggactccccaggtccttgctggtctacccaggtggcaccgatcagtacagatgatgtgattaagattctcaacagaatctctagaccaggcctcgtcacaatgtctaagacttcagagagtaaacctgcctattaaaaaaaaaaaaaggactcctcatttggttcaagggtcacctggtacctttaggagcccactggggccatctcaggcatctctgccgtttgatctcatgtcccaggcataataatgagaagctctcctcttatctgagctcacccaggaatcaagccccacctccctgctccaggctgatgcctcctagcagagcttacttccatcatcagcacctacaggcctgtgaggcaggagctggggatgttctgtcccggttgctcaaccccctcacattggctcccatttgcattaactgaacatgctcagggcacatgccaccctccttttcaaaagacccaggcctgcatgacaagttacttccccagcagcagccacccgccaaacataggtgaacagcaaggccacaaccccacggaaaaaaaagcagagaacttcagaaagcagcagctcaggcacaaggttagttaatcttcaatcacctggggaaaaaaaaagtttgtcacctcccaagggcctttgagtgggagctgccactggatgggcagaattacctaatctgcctggtacccctgaggttgccttgtccatccgcctgcctccagactggtcagcagggccaaccaggcacacaaagctctccagcaaaagagtgtcacccatccctccccagggtccactgaatgtccctgagctctcctgggctgtgactaacccagaccatggaggagtagagaccacttcctccatgaaactgggacacagatattcacctccccccaagaataaaccatgcttaaaggtggtctctagtcagacccagtcccttctcaggacttcttccctcccagatacaacttctcactccgttgacaagtcttagatcccaatctgttaaagctccaactaattttacagccagagttagataacaggaaaaagatatctcctttcctctcatcattgtcatcatcagtaacaatcacaataggtcccatttgttgagcaggcagatacgtgccttacacgtctctaatttaattctccctactcgacagctggggaaacaggctcgctaaagctccatgacttatccaagatcacacaaatagtagtggcagagctgggattccaactctggcccagttccttgaaatgttcccatttgcctccaggagagagggatatctatcttggccctgcagtgtgtacaaggcctggtacataggagacacccagaaaatacttgtttcataaatgactcaaaacatggatggacagtgcagggatgggtgaatgagtgagcaagttaaatgagctctgcttatctcaagaccagccccaaggcacacaggaagtggccgctgaggcaagaaggacctctcagctactgccccctcggtgcacgccactgctgctatgagggtctgtgattcagaaatgcggggagccaagcacctcaggtggcctcccctttcattcacctaaaatctgccttccgcatctctgggaaagcccctttccctgagctccccctcaggggtggcacctgccccaggcagggaagagggcctgatcctgcagagtggtgactctcccgtcgcgttaagacaaatgtgcatagatcccacactgggatctgtgcacagccactgtctctgggaatagccgtttccttaagaactctgactacgggtgtcactgaaagagaaggtgctgggattgccccttccccacaccccccttgcatttgggccttcatcagttttccccagtgagggcccctggtctccaagggaggactggagagagccagggctgtgaccagggcagctgccagtcctagcgaggctgccagccccatatcctggagcgcccagcaggagaggcggttctgagaaggcagcgagcagaaggacccgcagacgcagaggctcattacagggaatgactaagtgagctgcgcttccaagggaaaccccactcgcttctgctcgctgagacgctcatccttgagctattttgactaaggcggcttccaggtgctgccctccgctggggcagcccactgagagagcagccgggttgctggaggaccctctgcctggaagtcttggtcctggctattcaggtcgtctgacaggtctgccccacccgtttccagggcgggaaagtctgcccatcaccgattaaagtgagatgctgggaatgggggaaatccgatcagcacctcctaggtttttgcggctggatttcaataaggaatgtgacagtctcgcagcagctgtgccctgcctgaaacaagctctatttgaaacctccaacagctgaacccctcccagctacccgatggccagcccgcccagccacccccccaccaagccaccccctgccccaaatgacaaataaatagaaaaacccaagcaacaagcaggcgcatgcatacgtacaaacattacgcacatacacacacacacaccaacaaattgggggtgggggtatcgtggagccacttgtccaccgattcccaggtctccaagccttccagcccacagcaggagagctccccggcaagcagagcatcggcagaaacccaccttcctccatctccactccctctgggagggaaaccccctcctccgtcttggggctggactgagaggctggagcagtggggccagctccccgctaaagccagtgcctgctgttctccatccgggcgcgcactcacacacacactcatctttatttatcccaaggaggagttgaggtgggaggggagaactggggctgagctggggcgcgggcttgtggggaccgcctgggaagccctgtcatcccgtcccaaggagaggtgctcccccagctgattccaaggcggcgcccagctgctctgcccaggtaacacctgtagccatttttatcaggagatgtttacgaagcagcagcaggtttattctgagtcctctctcctgagggaaaggaccactgatttcctccacctatatttttaccccatgccctcaggagacccaggtcatggatggttttctattttgcccgagactctctgagaagaggagggaaacagaaacttgggaagagatggagaagacagggagagaagggacttgggcaatggtacggaatccccaccccccacccagacatttatttcttttttatcctcaggaaaatggagtggagcagggaggggaggaaagaaggggaagtcgcaggaactggcaaacacatgaaggcggagtgtaattaattggtgcgttaagctgctgggttatgctttagtacgagtgagccaggaggaaaagcgatttctcagaagggattattgaatcctccctaacagagagtctgcaaattagacacagtgtgtggggatgtcccctaccccccagaggaagctaggaatgaattctcccgggatcaagaaggaaaaccacgggaagttagagtgttgaatataactgagcaagcgcctctcaccaccaccaccacctctctctcccagtctccctcccaatctctcaatctctctctctctctctctctctctctctctctctcaatctctctctctcacaatccccctctctcaatccctctcttgctacctacatattccttttgttcaaggtataaagagaaaccacagcccctacctttgagtacaaaccccaagagagctcggtctctatcaccataacaacaattccaaacatcccaaaaatcagagcatagtcactcagtcgctttctcttttcaaacagggccctcctgtgtcccagcttatagccaatgttttggtttttccgcttgttggctttggggaaggtggtgctgctggcggtggtgccggcatgctggtggttgtgggtggcattagggtgatggagcagggtctggtgggcatggttgtcctcccgggaggagatgacgatctccggggggttgctagggctgaaaagctggaggggttggccctcagtctcggcctcgatgaggttcctccgggaggcgctgaggcggctgaggggcttcatgaccccaccgctatacttgcaggagctcatggcgatctccgtgaaggggttgctgtcccgccggtgcaccagggggctggcctgtcggtgccggctgcctccgccaggcccacttgtagctgtggaacttggagagtggccaagcaagtggtcattgagattgagctggctgccttgcctggaggaagggtggaggatggcggtggagttggacgaagggggggccctgaaagcggtgggagaggagtgcagcaggccagggtggacgggctggctctggagttgggcgagctgagacaggggatgcggtggctgctgctgctgctgctgctgctgctgctgctgctgctgctgaagctgcggaggctgaggctgcagcgagggtcccaggggctgctggggggctgctggtggcgctggcggtggtggctgctgctgctgttgctgctgctgctgctgctgctgctcatccccagaggatggacaggggcacttggggtcttcatccaagtcccccacccccgagtcatggaagtgcccagaagtgtccatcttggggcctggctgtattccctgcagcacaagcccccaccccaaagccaccctcgctccaaagatgtcctcaaagaaagccaggcatccaatctcccccaccagtatcttggctccagtcctctctttggcttgcttcggttctctggggctgcctggagtccagacgctgccactcaagaatgcattgtattgggcagggagggagagcaggaggggagcttggagaaagaagagggggtgaaagaactctctcaggaggtggtcctctaggagcgtgtgaggccaggctcagcttcactcctcgctggctc

SEQ ID NO: 2522 - DNA, 172814 bp, Homo sapiens; identical to SEQ ID NO: 2521
